US010077431B2

(12) United States Patent
Pouillot et al.

(10) Patent No.: US 10,077,431 B2
(45) Date of Patent: Sep. 18, 2018

(54) PHAGE THERAPY OF PSEUDOMONAS INFECTIONS

(71) Applicant: PHERECYDES PHARMA, Romainville (FR)

(72) Inventors: Flavie Pouillot, Paris (FR); Hélène Blois, Paris (FR)

(73) Assignee: PHERECYDES PHARMA, Romainville (FR)

( * ) Notice: Subject to any disclaimer, the term of this patent is extended or adjusted under 35 U.S.C. 154(b) by 0 days.

(21) Appl. No.: 15/031,763

(22) PCT Filed: Oct. 24, 2014

(86) PCT No.: PCT/EP2014/072905
§ 371 (c)(1),
(2) Date: Apr. 25, 2016

(87) PCT Pub. No.: WO2015/059298
PCT Pub. Date: Apr. 30, 2015

(65) Prior Publication Data
US 2016/0264941 A1 Sep. 15, 2016

(30) Foreign Application Priority Data
Oct. 25, 2013 (EP) .................................... 13306471

(51) Int. Cl.
| | |
|---|---|
| A01N 63/00 | (2006.01) |
| A61K 39/12 | (2006.01) |
| A61K 39/00 | (2006.01) |
| A61K 39/285 | (2006.01) |
| A61K 39/275 | (2006.01) |
| C12N 7/00 | (2006.01) |
| A61K 35/76 | (2015.01) |
| C07K 14/005 | (2006.01) |
| C12Q 1/18 | (2006.01) |

(52) U.S. Cl.
CPC .............. *C12N 7/00* (2013.01); *A61K 35/76* (2013.01); *C07K 14/005* (2013.01); *C12Q 1/18* (2013.01); *C12N 2795/10121* (2013.01); *C12N 2795/10122* (2013.01); *C12N 2795/10132* (2013.01); *C12N 2795/10171* (2013.01); *C12N 2795/10221* (2013.01); *C12N 2795/10222* (2013.01); *C12N 2795/10232* (2013.01); *C12N 2795/10271* (2013.01)

(58) Field of Classification Search
CPC .......... A61K 2300/00; A61K 2039/505; A61K 45/06; C07K 2317/76; C07K 2317/73
See application file for complete search history.

(56) References Cited

FOREIGN PATENT DOCUMENTS

EP 2465926 6/2012

OTHER PUBLICATIONS

Database EMBL, 2008, Pseudomonas phage SN, complete genome: accession No. FM887021: pdf pp. 1-32.*
Alemayehu et al. "Bacteriophages phiMR299-2 and phiNH-4 can eliminate pseudomonas aeruginosa in the murine lung and on cystic fibrosis lung airway cells" (mBio, 2012, 3(2):1-9).*
Alemayehu, D. et al. "Bacteriophages ɸMR299-2 and ɸNH-4 Can Eliminate *Pseudomonas aeruginosa* in the Murine Lung and on Cystic Fibrosis Lung Airway Cells" *MBIO*, Mar. 6, 2012, pp. 1-9, vol. 3, No. 2, Article No. e0002912.
Ceyssens, P.-J. et al. "Comparative analysis of the widespread and conserved PB1-like viruses infecting *Pseudomonas aeruginosa*" *Environmental Microbiology*, 2009, pp. 2874-2883, vol. 11, No. 11.
Fu, W. et al. "Bacteriophage Cocktail for the Prevention of Biofilm Formation by *Pseudomonas aeruginosa* on Catheters in an in Vitro Model System" *Antimicrobial Agents and Chemotherapy*, Jan. 1, 2010, pp. 397-404, vol. 54, No. 1.
Fukuda, K. et al. "*Pseudomonas aeruginosa* Keratitis in Mice: Effects of Topical Bacteriophage KPP12 Administration" *PLOS ONE*, Oct. 2012, pp. 1-8, vol. 7, No. 10, Article No. e47742.
Garbe, J. et al. "Characterization of JG024, a pseudomonas aeruginosa PB1-like broad host range phage under simulated infection conditions" *BMC Microbiology*, Nov. 26, 2010, pp. 1-10, vol. 10, No. 1.
Krylov, V. et al. "A Genetic Approach to the Development of New Therapeutic Phages to Fight *Pseudomonas aeruginosa* in Wound Infections" *Viruses*, Dec. 21, 2012, pp. 15-53, vol. 5.
McVay, C.S. et al. "Phage Therapy of *Pseudomonas aeruginosa* Infection in a Mouse Burn Wound Model" *Antimicrobial Agents and Chemotherapy*, Jun. 2007, pp. 1934-1938, vol. 51, No. 6.
Oikonomou, O. et al. "Investigation of carbapenem heteroresistance among different sequence types of *Pseudomonas aeruginosa* clinical isolates reveals further diversity" *J. Med. Microbiology*, May 19, 2011, pp. 1556-1558, vol. 60, No. 10.
Wright, A. et al. "A controlled clinical trial of a therapeutic bacteriophage preparation in chronic otitis due to antibiotic-resistant *Pseudomonas aeruginosa*; a preliminary report of efficacy" *Clin. Otolaryngol.* 2009, pp. 349-357, vol. 34.
Database EMBL [Online] Accession No. FM887071, "Comparative analysis of the widespread and conserved PB1-like viruses infecting Pseudomonas aeruginosa" Dec. 16, 2008, pp. 1-36, XP-002718979.
Database EMBL [Online] Accession No. AM910650, "Analysis of the genome, proteome and transcriptome of Pseudomonas aeruginosa phage LUZ24" Nov. 27, 2007, pp. 1-26, XP-002718980.
Database EMBL [Online] Accession No. JN254801, "Bacteriophages PhiMR299-2 and PhiNH-4 Can Eliminate Pseudomonas aeruginosa in the Murine Lung and on Cystic Fibrosis Lung Airway Cells" Apr. 27, 2012, pp. 1-32, XP-055161973.
Database EMBL [Online] Accession No. EU716414, "Comparative analysis of the widespread and conserved PB1-like viruses infecting Pseudomonas aeruginosa" Jan. 6, 2009, pp. 1-39, XP-002718981.
Database EMBL [Online] Accession No. JN254800, "Bacteriophages PhiMR299-2 and PhiNH-4 Can Eliminate Pseudomonas aeruginosa in the Murine Lung and on Cystic Fibrosis Lung Airway Cells" Mar. 13, 2012, pp. 1-41, XP-002718982.

(Continued)

*Primary Examiner* — Barry A Chestnut
(74) *Attorney, Agent, or Firm* — Saliwanchik, Lloyd & Eisenschenk

(57) ABSTRACT

The present invention relates to bacteriophage therapy. More particularly, the present invention relates to novel bacteriophages having a high specificity against *Pseudomonas aeruginosa* strains, their manufacture, components thereof, compositions comprising the same and the uses thereof in phage therapy.

22 Claims, 2 Drawing Sheets
Specification includes a Sequence Listing.

(56) References Cited

OTHER PUBLICATIONS

Database EMBL [Online] Accession No. GU815091, "Characterization of JG024, a pseudomonas aeruginosa PB1-like broad host range phage under simulated infection conditions" Dec. 16, 2010, pp. 1-64, XP-055162017.
Database EMBL [Online] Accession No. KC294142, "Pseudomonas aeruginosa phage PaP4" Jan. 16, 2013, pp. 1-29, XP-002718983.
Database EMBL [Online] Accession No. AB560486, "Pseudomonas aeruginosa Keratitis in Mice: Effects of Topical Bacteriophage KPP12 Administration" Aug. 23, 2012, pp. 1-35, XP-002718984.
Database EMBL [Online] Accession No. FM201282, "Genome and proteome analysis of newly isolated Pseudomonas aeruginosa phages" Aug. 22, 2008, pp. 1-37, XP-002718985.
Written Opinion in International Application No. PCT/EP2014/072905, dated Jan. 27, 2015, pp. 1-11.

\* cited by examiner

PHAGE THERAPY OF PSEUDOMONAS INFECTIONS

CROSS-REFERENCE TO RELATED APPLICATION

This application is the U.S. national stage application of International Patent Application No. PCT/EP2014/072905, filed Oct. 24, 2014.

The Sequence Listing for this application is labeled "Seq-List.txt" which was created on Apr. 8, 2016 and is 934 KB. The entire content of the sequence listing is incorporated herein by reference in its entirety.

The present invention relates to novel bacteriophages, compositions comprising the same, their manufacture, and the uses thereof. The invention is particularly adapted for the treatment of an infection in a mammal and for improving a subject condition by modifying the flora in said subject.

BACKGROUND OF THE INVENTION

Bacteriophages (or phages) are small viruses displaying the ability to infect and kill bacteria while they do not affect cells from other organisms. Initially described almost a century ago by William Twort, and independently discovered shortly thereafter by Felix d'Herelle, more than 6000 different bacteriophages have been discovered so far and described morphologically, including bacterial and archaeal viruses. The vast majority of these viruses are tailed while a small proportion are polyhedral, filamentous or pleomorphic. They may be classified according to their morphology, their genetic content (DNA vs. RNA), their specific host, the place where they live (marine virus vs. other habitats), and their life cycle. As intra-cellular parasites of bacterial cells, phages display different life cycles within the bacterial host: lytic, lysogenic, pseudo-lysogenic, and chronic infection (Weinbauer, 2004; Drulis-Kawa, 2012). Lytic phages cause lysis of the host bacterial cell as a normal part of their life cycle. Lysogenic phages (also termed temperate phages) can either replicate by means of the lytic life cycle and cause lysis of the host bacterium, or they can incorporate their DNA into the host bacterial DNA and become noninfectious prophages. Whatever the type of cycle of a phage life, the first step is the attachment to receptors of the bacterial cell wall before phage material may enter the bacteria. This specific process influences the spectrum of the possible phage-bacteria interactions.

Bacteriophages are commonly used as research tools to modify bacteria in laboratory experiments.

Because of their target host cell specificity, the use of phages as a therapy to treat acute and chronic infections has been considered, particularly in dermatology, ophthalmology, urology, stomatology, pediatrics, otolaryngology or surgery. This concept of therapeutic use of phages to treat bacterial infection was, however, highly controversial from the very beginning and not widely accepted by the public or medical community. Early studies were widely criticized for lack of appropriate controls and inconsistent results. The lack of reproducibility and many conflicting results obtained in the various published studies led the Council on Pharmacy and Chemistry of the American Medical Association to conclude that the evidence for the therapeutic value of lytic filtrates was for the most part contradictory and unconvincing, and recommend additional research to confirm its purported benefits.

Since the introduction of antibiotics in the 1940s, little attention was paid to this field of therapeutics, especially in the Western world. But the extensive use of antibiotics has led to the widespread emergence and spread of antibiotic-resistant bacteria around the world, causing increasingly serious problems. It has therefore become a major therapeutic challenge to overcome the limited therapeutic options remaining to treat major multi-drug resistant microbes.

In addition, many pathogenic microorganisms reside within biofilms, which biofilms cause additional problems when designing new anti-microbial agents. In this regard, bacteria growing as a biofilm rather than in single-celled ("planktonic") forms tend to be particularly resistant to anti-microbial agents and to be particularly difficult for the host immune system to render an appropriate response.

Since its initial discovery in the late 19th century (Fordos 1859), the Gram-negative bacterium *Pseudomonas aeruginosa* has gained a notorious place in the list of infamous human pathogens (Williams et al., 1894; Freeman et al., 1916). The arrival of the antibiotic era largely palliated the previously fatal outcome of acute infections in healthy patients. Only a relative improvement has been achieved in the eradication of chronic infections, which develop mainly in individuals suffering from cystic fibrosis or severe burns or who are immunocompromised (Gang et al., 1999; Jones et al., 2010). Two intrinsically related factors in the fatal outcome of infection in these patients are the rapid prescription of inappropriate antibiotic treatments and the development or acquisition of multidrug-resistant strains. While the use of (an) appropriate antibiotic(s) has been reported as an essential factor in the eradication of *P. aeruginosa* infections (Kang et al., 2005; Micek et al., 2005), conversely, antibiotic abuse significantly contributes to increasing resistance by exerting a continuous selective pressure for the acquisition of such capabilities. Antibiotics alone do not account for the high prevalence of multidrug-resistant variants: *P. aeruginosa* has multiple, chromosomally encoded intrinsic mechanisms of resistance, including low permeability of the cell envelope and numerous multidrug efflux pumps. Another major factor accounting for the successful invasive behavior and persistence of this bacterium is its high adaptability, allowing rapid colonization of different environments.

Furthermore, pathogenic bacteria such as *P. aeruginosa* are able to form biofilms, which contribute to their increased resistance to antibiotics. Such biofilms may comprise more than one type of bacteria supported and surrounded by an excreted extracellular matrix, and assist bacteria to colonize various surfaces. Biofilms allow bacteria to attach to surfaces and to reach population densities which would otherwise be unsupportable, imparting increased resistance to not only antibiotics but many environmental stresses including toxins such as heavy metals, bleaches and other cleaning agents. It is known that bacteria within biofilms can be 100 to 1000 times more resistant to antibiotics than the same strain of bacteria growing in planktonic forms. Such an increased resistance means that bacteria that are apparently sensitive to antibiotics in a laboratory test may be resistant to therapy in a clinical setting. Even if some are cleared, biofilms may provide resistant reservoirs permitting rapid colonization once antibiotics are no longer present. It is therefore obvious that biofilms are major factors in many human diseases. Chemical treatments are unsuited for use against biofilms since this is precisely what they have evolved to counter. Physical abrasion does provide a means to disrupt biofilms. Unfortunately, many surfaces where biofilms support bacterial pathogenesis are poorly suited to rigorous abrasion, i.e., bones, joints, implanted medical devices, etc. For example, the surfaces of wounds or burns are extremely sensitive and delicate. Even where abrasion is both suitable and in routine use, clearing of biofilms is limited. Oral plaque on the surface of teeth is a biofilm and is partially cleared by regular brushing. However, bacteria are maintained on unbrushed surfaces (for example in the gaps between teeth) and can recolonize cleared surfaces both rapidly and effectively. From this, it is clear that existing approaches to clearing biofilms are of limited efficacy.

The capability for quick adaptation and the ability to form biofilms are the main reasons that identify *P. aeruginosa* as opportunistic pathogens. They have acquired the status of hospital pathogens, and may be isolated from clinical samples taken from wounds, sputum, bladder, urethra, vagina, ears, eyes and respiratory tract. The emergence of resistance to the most powerful new antibiotics in such clinical *P. aeruginosa* strains, occurring even during treatment, makes the fight with *P. aeruginosa* hospital pathogens a great problem.

Furthermore, it has been reported that the pathological or physiological condition of a subject is influenced by the balance of microorganisms in the flora of the subject. Accordingly, modifying the microbial flora, or modifying said balance, or restoring said balance, by destroying *P. aeruginosa* population, is also a valuable approach for improving a subject condition.

Therefore, there is a great need for new antibacterial agents or compositions that can be used to destroy *P. aeruginosa* strains, even when organized in bacterial biofilms, suitable for use in human or animal therapy, as well, as for decontaminating materials.

SUMMARY OF THE INVENTION

The inventors have isolated and characterized new bacteriophages presenting specific lytic activity to *Pseudomonas aeruginosa* (*P. aeruginosa*), which can be used as active agents in pharmaceutical or veterinary preparations, particularly to treat *P. aeruginosa* bacterial infections or to modify microbial balance in a subject. The new bacteriophages of the invention exhibit strong lytic activity and high selectivity, and can be combined to induce controlled destruction of a very large spectrum of *P. aeruginosa* cells.

An object of the invention is to provide antibacterial compositions comprising at least one, preferably at least two bacteriophages having lytic activity against a *Pseudomonas aeruginosa* (*P. aeruginosa*) strain, said bacteriophages being selected from the bacteriophages having a genome comprising a nucleotide sequence of any one of SEQ ID NOs: 1 to 13 or a sequence having at least 90% identity thereto.

A further object of the invention relates to a bacteriophage having lytic activity to a *Pseudomonas aeruginosa* (*P. aeruginosa*) strain and having a genome comprising a nucleotide sequence selected from any one of SEQ ID NOs: 1 to 13 or a sequence having at least 97% identity thereto.

The bacteriophages of the invention exhibit lytic activity to multi drug resistant strains of *P. aeruginosa*, in particular to antibiotic resistant pathogenic strains, such as cephalosporinase, carbenicillinases and extended-spectrum β-lactamases (Strateva T. and Yordanov D. 2009).

In another aspect, the invention is related to a bacteriophage having lytic activity to a pathogenic *P. aeruginosa* strain, wherein the bacteriophage is specific for *P. aeruginosa*, active against antibiotic-resistant *P. aeruginosa* strains, and has a productive lytic effect below 20.

The invention further concerns an isolated nucleic acid contained in a bacteriophage of the invention, preferably an isolated nucleic acid molecule comprising a nucleotide sequence selected from any one of SEQ ID NOs: 1 to 13 or a sequence having at least 97% identity thereto, as well as an isolated polypeptide encoded by said nucleic acid.

Another object of the invention is a composition comprising a nucleic acid or polypeptide as defined above.

The compositions of the invention typically further comprise a pharmaceutically or veterinary acceptable excipient or carrier. They may be liquid, semi-liquid, solid or lyophilized.

Another object of the invention relates to a bacteriophage, nucleic acid, polypeptide or composition as defined above, for use in the treatment of an infection in a mammal, for modifying the microbial flora in a mammal, for decontaminating a material and/or for killing a *P. aeruginosa* bacterium or for compromising the integrity of a bacterial biofilm.

The invention relates also to the use of one or several lytic bacteriophages to improve a subject condition by modifying the microbial flora in said subject. The microbial flora may be modified by correcting, adapting or restoring a proper balance of microorganisms in said flora.

The invention also relates to a method for treating an infection in a mammal, comprising the administration to said mammal of at least one bacteriophage, nucleic acid, polypeptide or composition as defined above.

The invention also relates to a method for treating a surface or material suspected of being contaminated with a *P. aeruginosa* bacterium, comprising applying to said surface or material at least one bacteriophage, nucleic acid, polypeptide or composition as defined above. The surface or material may be a surface of any device, vessel or laboratory material, cloth, etc.

A further object of the invention relates to a kit comprising a composition as defined above and a means for applying the same to a subject or surface.

Another object of the invention relates to a method for predicting or determining efficacy of a bacteriophage therapy in a subject, wherein the method comprises determining in vitro a lytic activity of one or more bacteriophages of the invention to a *P. aeruginosa* strain from a sample of said subject, a lytic activity of one or more bacteriophages of the invention to at least one *P. aeruginosa* strain from said sample being indicative of an efficient treatment. The method further optionally comprises the step of treating the subject with at least one bacteriophage having a lytic activity to a *P. aeruginosa* strain from a sample of said subject.

In another aspect, the invention provides a method for selecting a subject or determining whether a subject is susceptible to benefit from a bacteriophage therapy, wherein the method comprises the step of determining in vitro a lytic activity of one or more bacteriophages of the invention to a *P. aeruginosa* strain from a sample of said subject, a lytic activity of one or more of said bacteriophages to at least one *P. aeruginosa* strain being indicative of a responder subject.

The invention may be used in any mammal, preferably in human beings, or to treat any material, including laboratory materials or medical devices.

DETAILED DESCRIPTION OF THE INVENTION

Figure 1:
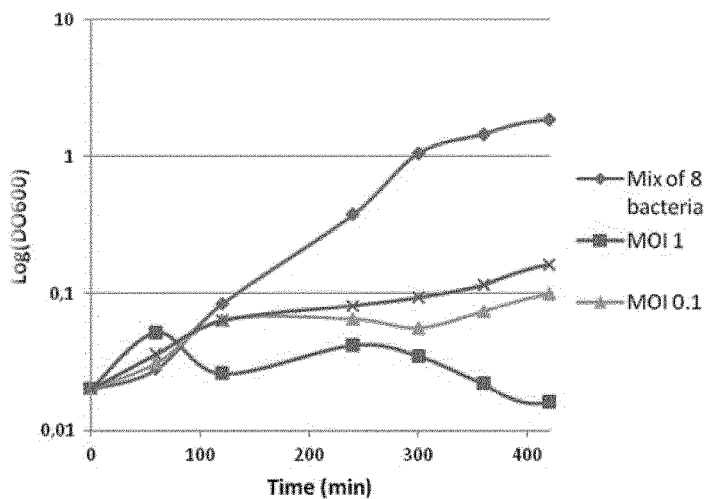
FIG. 1: In vitro efficacy of Bacteriophages of the invention on various combinations of *P. aeruginosa* strains.

The present invention relates to novel bacteriophages, components thereof, compositions comprising the same, their manufacture, and the uses thereof as antibacterial agents, particularly for the treatment of an infection in a mammal and for improving a subject condition by modifying the microbial flora in said subject.

Definitions

To facilitate understanding of the invention, a number of terms are defined below.

As used herein, the term "bacteriophage" or "phage" refers to a functional phage particle comprising a nucleic acid genome packaged in a proteinaceous envelope or capsid. The term also refers to portions of the bacteriophage, including, e.g., a head portion, or an assembly of phage components, which provide substantially the same functional activity.

The term "phenotypic characteristic" designates more preferably the morphology and/or host-range of a bacteriophage. Methods for phenotyping bacteriophages are well known per se in the art and include, for example, determining bacterial host range and/or activity against the biofilm produced by certain bacterial strains.

The term "lytic activity" as used in the invention designates the property of a bacteriophage to cause lysis of a bacterial cell. The lytic activity of a bacteriophage can be tested on P. aeruginosa strains according to techniques known per se in the art (see also Examples section).

The term "variant" of a reference bacteriophage designates bacteriophages having variation(s) in the genomic sequence and/or polypeptide(s) encoded thereby as compared to said reference bacteriophage, while retaining the same phenotypic characteristics as the reference bacteriophage. Variants typically comprise, e.g., silent mutations, conservative mutations, minor deletions, and/or minor replications of genetic material, and retains phenotypic characteristics of the reference bacteriophage. In a preferred embodiment, the variant of the invention retain any observable characteristic or property that is dependent upon the genome of the bacteriophage of the invention, i.e. phenotypic characteristics of said bacteriophage and/or lytic activity against the P. aeruginosa strains. Preferred variants have less than 5% nucleic acid variation as compared to the genome of the reference bacteriophage, even more preferably less than 4%, more preferably less than 2%. Alternatively, or in combination, variants have preferably less than 5% amino acid variation in a coded polypeptide sequence as compared to a polypeptide of the reference bacteriophage.

The term "% identity" in relation to nucleic acid or amino acid sequences designates the level of identity or homology between said sequences and may be determined by techniques known per se in the art. Typically, the % identity between two nucleic acid or amino acid sequences is determined by means of computer programs such as GAP provided in the GCG program package (Program Manual for the Wisconsin Package, Version 8, August 1996, Genetics Computer Group, 575 Science Drive, Madison, Wis., USA 53711) (Needleman, S. B. and Wunsch, C. D., 1970, Journal of Molecular Biology, 48, 443-453). With settings adjusted to e.g., DNA sequences (particularly, GAP creation penalty of 5.0 and GAP extension penalty of 0.3), nucleic acid molecules may be aligned to each other using the Pileup alignment software available as part of the GCG program package. The % identity between two sequences designates the identity over the entire length of said sequences.

The term "fragment" of a nucleic acid designates typically a fragment having at least 10 consecutive nucleotides of said nucleic acid, more preferably at least 15, 20, 25, 30, 35, 40, 50 or more consecutive nucleotides of said nucleic acid.

The term "fragment" of a polypeptide designates typically a fragment having at least 5 consecutive amino acids of said polypeptide, more preferably at least 10, 15, 20, 30, 40, 50 or more consecutive amino acids of said polypeptide.

The terms "ESBL P. aeruginosa strain" refers to cephalosporinase and/or extended-spectrum β-lactamases producing P. aeruginosa strains, including various forms of antibiotic resistance such as AmpC β-lactamase or Class A carbenicillin hydrolyzing β-lactamases, etc.

The term "specific" or "specificity" in relation to a bacteriophage refers to the type of host that said bacteriophage is able to infect. Specificity is usually mediated by the tail fibers of bacteriophages, which are involved in the interaction with receptors expressed on cells. A bacteriophage "specific" for P. aeruginosa more preferably designates a bacteriophage which can infect one or several P. aeruginosa strains and which cannot infect non-P. aeruginosa bacteria under physiological conditions.

As used herein, the term "polypeptide" refers to polypeptides of any size, including small peptides of e.g., from 5 to 20 amino acids, longer polypeptides, proteins or fragments thereof.

The term "PLE" or "Productive Lytic Effect" designates the ratio between burst size and productive lytic time of a given bacteriophage. Burst size and productive lytic time are parameters defining phage-host interaction and correspond, respectively, to the mean yield of bacteriophage particles produced by infection of one bacterium by one phage, and to the time taken by a free bacteriophage to lyse a bacterial cell.

In the context of the present specification, the term "isolated bacteriophage" should be considered to mean material removed from its original environment in which it naturally occurs. In relation to a bacteriophage, the term designates, particularly, a phage that is e.g., cultivated, purified and/or cultured separately from the environment in which it is naturally located. In relation to a nucleic acid or polypeptide, the term "isolated" designates e.g., a nucleic acid molecule or polypeptide which is separated from at least some of the components of its natural environment such as, e.g., a protein, lipid, and/or nucleic acid.

The term "pharmaceutically or veterinary acceptable" as used herein refers to any material (e.g., carrier, excipient or vehicle) that is compatible for use in a mammalian subject. Such includes physiologically acceptable solutions or vehicles that are harmless or do not cause any significant specific or non-specific immune reaction to an organism or do not abrogate the biological activity of the active compound. For formulation of the composition into a liquid preparation, saline, sterile water, Ringer's solution, buffered physiological saline, albumin infusion solution, dextrose solution, maltodextrin solution, glycerol, ethanol, and mixtures thereof may be used as a pharmaceutically or veterinary acceptable excipient or carrier. If necessary, other conventional additives such as thickeners, diluents, buffers, preservatives, surface active agents, antioxidants and bacteriostatic agents may be added. Further, diluents, dispersants, surfactants, binders and lubricants may be additionally added to the composition to prepare injectable formulations such as aqueous solutions, suspensions, and emulsions, oral formulations such as pills, capsules, granules, or tablets, or powdered formulations.

As used herein, "PFU" means plaque forming unit, as it is well defined in the art. Lytic bacteriophages lyse the host cell, causing a zone of clearing (or plaque) on a culture plate.

Theoretically, each plaque is formed by one phage and the number of plaques multiplied by the dilution factor is equal to the total number of phages in a test preparation.

The term "treatment" or "therapy" designates a curative or a prophylactic treatment of a disease. A curative treatment is defined as a treatment that results in a cure of a disease, or a treatment that alleviates, reduces, stabilizes, or eliminates the symptoms of a disease or the suffering that it causes, directly or indirectly, or that improves a subject condition or reduces progression of a disease. A prophylactic treatment comprises both a treatment resulting in the prevention of a disease and a treatment reducing and/or delaying the incidence of a disease or the risk of its occurrence.

The term "mammal" includes human subjects as well as non-human mammals such as pets (e.g., dogs, cats), horses, ruminants, sheep, goats, pigs, etc.

The term "biofilm" as used herein designates a heterogeneous bacterial formation growing on various surfaces; preferably a bacterial community growing embedded in an exopolysaccharide matrix adhered onto solid biological or non-biological surfaces.

The term "compromise" as used herein refers to any alteration of the integrity. By compromising a bacterial biofilm, it is understood a penetration of the biofilm by bacteriophage, an infection of biofilm-associated bacteria and/or a lysis thereof and/or a partial or an entire clearing of the biofilm (i.e., by stopping colonization and/or disrupting biofilms).

The term "sample", as used herein, means any sample containing cells. Examples of such samples include fluids such as blood, plasma, saliva, or urine as well as biopsies, organs, tissues or cell samples. The sample may be treated prior to its use.

As used herein, the term "subject" or "patient" refers to an animal, preferably to a mammal, even more preferably to a human, including adult and child. However, the term "subject" also encompasses non-human animals, in particular mammals such as dogs, cats, horses, cows, pigs, sheep and non-human primates, among others.

The term "efficacy" of treatment or "response" to a bacteriophage therapy as used herein refers to a treatment which results in a decrease in the number of *P. aeruginosa* strains in a subject after bacteriophage treatment when compared to the number of *P. aeruginosa* strains before treatment. A "good responder" subject refers to a subject who shows or will show a clinically significant recovery when treated with a bacteriophage therapy.

The term "Cocktail" or composition of bacteriophages designates a combination of different types of bacteriophages. The bacteriophages in a cocktail/composition are preferably formulated together, i.e., in a same vessel or packaging, although they may be used as kits of parts wherein the (or some of the) bacteriophages are formulated or packaged separately and combined when used or administered.

DESCRIPTION OF EMBODIMENTS

The present invention is related to novel bacteriophage therapies. More particularly, the present invention relates to novel bacteriophages having a high specificity against *Pseudomonas aeruginosa* strains, their manufacture, components thereof, compositions comprising the same and the uses thereof in phage therapy.

Bacteriophages:

In a first aspect, the invention discloses the isolation and characterization of novel bacteriophages that are specific for *P. aeruginosa* strains and present, either alone or in combination(s), remarkable host range spectrum of lytic activity. These bacteriophages have been selected from environmental samples, isolated, sequenced, and characterized. As indicated, the bacteriophages are, individually and in combination(s), active against *P. aeruginosa* strains. They are remarkably effective against pathogenic *P. aeruginosa* strains, such as antibiotic-resistant *P. aeruginosa* strains, such as an ESBL *P. aeruginosa* strain. Furthermore, bacteriophages of the invention have a remarkably productive lytic effect ("PLE") below 20, more preferably below 15 and still more preferably between 0.3 and 15. Moreover, the bacteriophages of the invention are specific for *P. aeruginosa* strains, i.e., they do not cause lysis of non-*P. aeruginosa* bacteria. As will be illustrated further, the invention shows that these bacteriophages can be combined and formulated in conditions suitable for use as pharmaceutical or veterinary agents to exhibit targeted and very potent antibacterial effect against a controlled spectrum of *P. aeruginosa* strains.

More specifically, the following bacteriophages have been selected and characterized. Their corresponding nucleic acid sequences are also indicated.

TABLE 1

| SEQ ID number | Bacteriophage |
| --- | --- |
| SEQ ID NO: 1 | BP1384 |
| SEQ ID NO: 2 | BP1429 |
| SEQ ID NO: 3 | BP1430 |
| SEQ ID NO: 4 | BP1433 |
| SEQ ID NO: 5 | BP1450 |
| SEQ ID NO: 6 | BP1644 |
| SEQ ID NO: 7 | BP1647 |
| SEQ ID NO: 8 | BP1648 |
| SEQ ID NO: 9 | BP1649 |
| SEQ ID NO: 10 | BP1650 |
| SEQ ID NO: 11 | BP1658 |
| SEQ ID NO: 12 | BP1661 |
| SEQ ID NO: 13 | BP1662 |

The lytic profile of these bacteriophages has been determined on a broad number of *P. aeruginosa* strains. These bacteriophages have been selected for their potency and combination potential, as disclosed in the following table. In this table, the lytic effect of the bacteriophages on reference and pathogen-resistant strains are presented, to confirm the high lytic potential.

TABLE 2

| Bacteria | Phage |  |  |  |  |  |  |  |  |  |  |  |  |
|---|---|---|---|---|---|---|---|---|---|---|---|---|---|
|  | 1384 | 1429 | 1430 | 1433 | 1450 | 1644 | 1647 | 1648 | 1649 | 1650 | 1658 | 1661 | 1662 |
| LMG 24882 | + | + | + | + | + | + | + | + | + | + | + | + |  |
| LMG 24883 | + | +/− | + | + | + | + | + | + | + |  |  | + | + |
| LMG 24886 | + |  |  | + | + | + | +/− |  | + |  | +/− | + |  |
| LMG 24887 | +/− | +/− | +/− | + | + | +/− |  |  | + |  | + | +/− | +/− |
| LMG 24891 | + | + | + | + | + | + | + | + | + |  | + | + | + |
| LMG 24892 | + | + | + | + | + | + | + |  | + |  | +/− | + | + |
| LMG 24893 | + | + | + | + | + | + | + | + | + | + | + | + | + |
| LMG 24896 | + | + | + | + | + | + | + | + | + | + | + | + | + |
| LMG 24898 | + | + | + | + | + | + | + | + | + | + | + | + | + |
| LMG 24901 |  | +/− | + |  |  |  | +/− |  |  |  |  |  |  |
| LMG 24903 |  |  | +/− | +/− | + |  | + |  |  |  |  |  | +/− |
| LMG 24904 |  | +/− | +/− | +/− | + |  |  |  |  |  |  |  | +/− |
| LMG 24905 | +/− |  |  | + | + | + |  |  | + | + |  |  |  |
| LMG 24909 | + | +/− |  | + | + | + |  | + | + | + | +/− | + |  |
| LMG 24913 |  |  |  | +/− | + |  |  |  | + | +/− | +/− |  |  |
| LMG 24916 |  | + | + | + |  |  | + |  |  |  |  |  | + |

Further results on highly resistant strains from wound or burn are presented below, further confirming the remarkable activity profile of the bacteriophages of the invention, and their complementarity.

TABLE 3

|  | 1384 | 1429 | 1430 | 1433 | 1450 | 1644 | 1647 | 1648 | 1649 | 1650 | 1658 | 1661 | 1662 | CAR* |
|---|---|---|---|---|---|---|---|---|---|---|---|---|---|---|
| LMG 25000 | + | + | + | − | + | + | + | − | + | − | + | + | − | 1 |
| LMG 25122 | − | − | − | − | + | + | − | − | + | − | + | + | − | 5 |
| LMG 25140 | − | + | − | − | + | + | − | − | + | − | + | + | + | 5 |
| LMG 25133 | − | − | − | + | + | − | + | − | − | − | + | + | − | 2 |
| LMG 25165 | − | − | + | − | − | − | + | − | − | − | − | + | − | 5 |
| LMG 25146 | − | − | − | − | + | + | − | − | + | − | + | + | − | 4 |

*CAR: Class ATB Resistance

As can be seen from Tables 2 and 3, the phages have individually very strong lytic power, and combinations (or cocktails) of these bacteriophages may be produced that are able to kill all of the tested *P. aeruginosa* strains, thereby producing broad spectrum antibacterial compositions.

As an illustration, a cocktail of all 13 phages of the invention is able to effectively kill all bacteria listed in Table 2 and Table 3.

Moreover, the specificity of the bacteriophages has been tested on many non-*P. aeruginosa* strains. More particularly, the Examples section demonstrates that the bacteriophages of the invention have no lytic effect on any bacteria selected from *Escherichia coli, Acinetobacter baumannii, Enterobacter aerogenes, Enterobacter asburiae, Enterobacter cloacae, Klebsiella pneumonia, Porteus mirabilis, Staphylococcus aureus, Stenotrophomonas maltophilia* and/or *Serratia marcescens*.

A particular object of the invention thus resides in a bacteriophage having lytic activity to a *P. aeruginosa* strain and having a genome comprising a nucleotide sequence selected from any one of SEQ ID NOs: 1 to 13 or a sequence having at least 97% identity thereto, preferably at least 98% or 99% identity thereto.

The bacteriophages of the invention may be cultured, expanded, isolated, purified, and used in e.g., phage therapy of *P. aeruginosa*-mediated disorders, as will be disclosed in more detail below. Furthermore, variants of these bacteriophages retaining a phenotypic (e.g., specificity and lytic activity) of the bacteriophages can be produced and/or isolated by techniques known per se in the art.

The bacteriophages of the invention can be prepared by standard culture, isolation and purification methods. For example, *P. aeruginosa* producing bacteria are cultured, infected by a sample of a bacteriophage, and then treated to remove bacterial cells and debris. The enriched bacteriophage solution can be plated in a medium, for example agar medium, with embedded susceptible host strains of *P. aeruginosa* to obtain plaques. Then, single plaque can be picked out for subsequent bacteriophage purification and amplification. One or more cycles of selective amplification of bacteriophages of the invention may be performed, for example by mixing bacteriophages with the competent *P. aeruginosa*, followed by addition of a growth medium and incubation at selected test growing conditions. Following centrifugation, the cleared amplified supernatant is filtered through filter and subjected to another cycle of selective amplification or tested for presence of lytic activity.

The titer of phage in a suspension and the visualization of plaque morphology of bacteriophages of the invention may then be assessed by known methods, for example by plaque counting. Additionally, processing bacteriophages of the invention in various forms (liquid, lyophilized, etc.) for short-, long-, freeze- or any other kind of storage can be carried out by any suitable method as it is well-known in the art (see e.g., Clark, 1962).

The activity of the bacteriophages of the invention can be assessed by methods well-known in the art, such as plaque assay also known as double agar method, based on the growing of bacteriophage with potential host bacteria and followed by assessing their ability to kill the host bacterial cell. In the plaque assay method, the bacteriophage induces lysis of target *P. aeruginosa* strains after a period of incubation in soft agar medium, resulting in zones of clearing on the plate known as plaques.

In a particular embodiment, the invention is related to BP1384 bacteriophage, or any variant thereof. BP1384 bacteriophage, or any variant thereof, can be produced or expanded in e.g., *P. aeruginosa* strain PAO1. BP1384, or any variant thereof, is specific and has lytic activity against LMG24882, LMG24883, LMG24886, LMG24891, LMG24892, LMG24893, LMG24896, LMG24898 and/or LMG24909 strains. BP1384 comprises a genome comprising a sequence as set forth in SEQ ID NO: 1 or having at least 80% identity, more preferably at least 85% identity, and still more preferably 90%, 92%, 94%, 95%, 96%, 97%, 98% or 99% identity to SEQ ID NO: 1. It is also provided an isolated nucleic acid sequence from BP1384 bacteriophage, or variant thereof. The invention also encompasses isolated polypeptides encoded by BP1384 bacteriophage, or variant thereof, or encoded by an isolated nucleic acid sequence from BP1384 bacteriophage of the invention. BP1384 bacteriophage of the invention is also characterized by a PLE below 20, more preferably below 15 and still more preferably of around 6.2.

In another particular embodiment, the invention is related to BP1429 bacteriophage, or any variant thereof. BP1429 bacteriophage, or any variant thereof, can be produced or expanded in e.g., *P. aeruginosa* strain PAO1. BP1429, or any variant thereof, is specific and has lytic activity against LMG24882, LMG24891, LMG24892, LMG24893, LMG24896, LMG24898 and/or LMG24916 strains. BP1429 comprises a genome comprising a sequence as set forth in SEQ ID NO: 2 or having at least 80% identity, more preferably at least 85% identity, and still more preferably 90%, 92%, 94%, 95%, 96%, 97%, 98% or 99% identity to SEQ ID NO: 2. It is also provided an isolated nucleic acid sequence from BP1429 bacteriophage, or variant thereof. The invention also encompasses isolated polypeptides encoded by BP1429 bacteriophage, or variant thereof, or encoded by an isolated nucleic acid sequence from BP1429 bacteriophage of the invention. BP1429 bacteriophage of the invention is also characterized by a PLE below 20, more preferably below 15 and still more preferably of around 0,70.

In still another aspect, the invention is related to BP1430 bacteriophage, or any variant thereof. BP1430 bacteriophage, or any variant thereof, can be produced or expanded in e.g., *P. aeruginosa* strain PAO1. BP1430, or any variant thereof, is specific for and has lytic activity against LMG24882, LMG24883, LMG24891, LMG24892, LMG24893, LMG24896, LMG24898, LMG24901 and/or LMG24918 strains. BP1430 comprises a genome comprising a sequence as set forth in SEQ ID NO: 3 or having at least 80% identity, more preferably at least 85% identity, and still more preferably 90%, 92%, 94%, 95%, 96%, 97%, 98% or 99% identity to SEQ ID NO: 3. It is also provided an isolated nucleic acid sequence from B1430 bacteriophage, or variant thereof. The invention also encompasses isolated polypeptides encoded by BP1430 bacteriophage, or variant thereof, or encoded by an isolated nucleic acid sequence from BP1430 bacteriophage of the invention. BP1430 bacteriophage of the invention is also characterized by a PLE below 20, more preferably below 15 and still more preferably of around 3.

In another aspect, the invention is related to BP1433 bacteriophage, or any variant thereof. BP1433 bacteriophage, or any variant thereof, can be produced or expanded in e.g., *P. aeruginosa* strain PAO1. BP1433, or any variant thereof, is specific and has lytic activity against LMG24882, LMG24883, LMG24886, LMG24887, LMG24891, LMG24892, LMG24893, LMG24896, LMG24896, LMG24905, LMG24909 and/or LMG24916 strains. BP1433 comprises a genome comprising a sequence as set forth in SEQ ID NO: 4 or having at least 80% identity, more preferably at least 85% identity, and still more preferably 90%, 92%, 94%, 95%, 96%, 97%, 98% or 99% identity to SEQ ID NO: 4. It is also provided an isolated nucleic acid sequence from BP1433 bacteriophage, or variant thereof. The invention also encompasses isolated polypeptides encoded by BP1433 bacteriophage, or variant thereof, or encoded by an isolated nucleic acid sequence from BP1433 bacteriophage of the invention. BP1433 bacteriophage of the invention is also characterized by a PLE below 20, more preferably below 15 and still more preferably of around 4.

In another particular embodiment, the invention is related to BP1450 bacteriophage, or any variant thereof. BP1450 bacteriophage, or any variant thereof, can be produced or expanded in e.g., *P. aeruginosa* strain PAO1. BP1450, or any variant thereof, is specific for and has lytic activity against LMG24882, LMG24883, LMG24886, LMG24887, LMG24891, LMG24892, LMG24893, LMG24896, LMG24898, LMG24903, LMG24904, LMG24905, LMG24909 and/or LMG24913 strains. BP1450 comprises a genome comprising a sequence as set forth in SEQ ID NO: 5 or having at least 80% identity, more preferably at least 85% identity, and still more preferably 90%, 92%, 94%, 95%, 96%, 97%, 98% or 99% identity to SEQ ID NO: 5. It is also provided an isolated nucleic acid sequence from BP1450 bacteriophage, or variant thereof. The invention also encompasses isolated polypeptides encoded by BP1450 bacteriophage, or variant thereof, or encoded by an isolated nucleic acid sequence from BP1450 bacteriophage of the invention. BP1450 bacteriophage of the invention is also characterized by a PLE below 20, more preferably below 15 and still more preferably of around 2.

In still another aspect, the invention is related to BP1644 bacteriophage, or any variant thereof. BP1644 bacteriophage, or any variant thereof, can be produced or expanded in e.g., *P. aeruginosa* strain PAO1. BP1644, or any variant thereof, is specific and has lytic activity against LMG24882, LMG24883, LMG24886, LMG24891, LMG24892, LMG24893, LMG24896, LMG24898, LMG24905 and/or LMG24909 strains. BP1644 comprises a genome comprising a sequence as set forth in SEQ ID NO: 6 or having at least 80% identity, more preferably at least 85% identity, and still more preferably 90%, 92%, 94%, 95%, 96%, 97%, 98% or 99% identity to SEQ ID NO: 6. It is also provided an isolated nucleic acid sequence from BP1644 bacteriophage, or variant thereof. The invention also encompasses isolated polypeptides encoded by BP1644 bacteriophage, or variant thereof, or encoded by an isolated nucleic acid sequence from BP1644 bacteriophage of the invention. BP1644 bacteriophage of the invention is also characterized by a PLE below 20, more preferably below 15 and still more preferably of around 1,5.

In another particular embodiment, the invention is related to BP1647 bacteriophage, or any variant thereof. BP1647 bacteriophage, or any variant thereof, can be produced or expanded in, e.g., *P. aeruginosa* strain PAO1. BP1647, or any variant thereof, is specific for and has lytic activity against LMG24882, LMG24883, LMG24891, LMG24892, LMG24893, LMG24896, LMG24898, LMG24903 and/or LMG24916 strains. BP1647 comprises a genome comprising a sequence as set forth in SEQ ID NO: 7 or having at least 80% identity, more preferably at least 85% identity, and still more preferably 90%, 92%, 94%, 95%, 96%, 97%, 98% or 99% identity to SEQ ID NO: 7. It is also provided an isolated nucleic acid sequence from BP1647 bacteriophage, or variant thereof. The invention also encompasses isolated polypeptides encoded by BP1647 bacteriophage, or variant thereof, or encoded by an isolated nucleic acid sequence from BP1647 bacteriophage of the invention. BP1647 bacteriophage of the invention is also characterized by a PLE below 20, more preferably below 15 and still more preferably of around 0,4.

In another particular embodiment, the invention is related to BP1648 bacteriophage, or any variant thereof. BP1648 bacteriophage, or any variant thereof, can be produced or expanded in e.g., *P. aeruginosa* strain PAO1. BP1648, or any variant thereof, is specific for and has lytic activity against LMG24882, LMG24883, LMG24891, LMG24893, LMG24896, LMG24898, and/or LMG24909 strains. BP1648 comprises a genome comprising a sequence as set forth in SEQ ID NO: 8 or having at least 80% identity, more preferably at least 85% identity, and still more preferably 90%, 92%, 94%, 95%, 96%, 97%, 98% or 99% identity to SEQ ID NO: 8. It is also provided an isolated nucleic acid sequence from BP1648 bacteriophage, or variant thereof. The invention also encompasses isolated polypeptides encoded by BP1648 bacteriophage, or variant thereof, or encoded by an isolated nucleic acid sequence from BP1648 bacteriophage of the invention. BP1648 bacteriophage of the invention is also characterized by a PLE below 20, more preferably below 15 and still more preferably of around 2.

In another aspect, the invention is related to BP1649 bacteriophage, or any variant thereof. BP1649 bacteriophage, or any variant thereof, can be produced or expanded in e.g., *P. aeruginosa* strain PAO1. BP1649, or any variant thereof, is specific for and has lytic activity against LMG24882, LMG24883, LMG24886, LMG24887, LMG24891, LMG24892, LMG24893, LMG24896, LMG24898, LMG24905, LMG24909 and/or LMG24913 strains. BP1649 comprises a genome comprising a sequence as set forth in SEQ ID NO: 9 or having at least 80% identity, more preferably at least 85% identity, and still more preferably 90%, 92%, 94%, 95%, 96%, 97%, 98% or 99% identity to SEQ ID NO: 9. It is also provided an isolated nucleic acid sequence from BP1649 bacteriophage, or variant thereof. The invention also encompasses isolated polypeptides encoded by BP1649 bacteriophage, or variant thereof, or encoded by an isolated nucleic acid sequence from BP1649 bacteriophage of the invention. BP1155 bacteriophage of the invention is also characterized by a PLE below 20, more preferably below 15 and still more preferably of around 3,5.

In another particular embodiment, the invention is related to BP1650 bacteriophage, or any variant thereof. BP1650 bacteriophage, or any variant thereof, can be produced or expanded in e.g., *P. aeruginosa* strain PAO1. BP1650, or any variant thereof, is specific for and has lytic activity against LMG24882, LMG24893, LMG24896, LMG24898, LMG24905, and/or LMG24909 strains. BP1650 comprises a genome comprising a sequence as set forth in SEQ ID NO: 10 or having at least 80% identity, more preferably at least 85% identity, and still more preferably 90%, 92%, 94%, 95%, 96%, 97%, 98% or 99% identity to SEQ ID NO: 10. It is also provided an isolated nucleic acid sequence from BP1650 bacteriophage, or variant thereof. The invention also encompasses isolated polypeptides encoded by BP1650 bacteriophage, or variant thereof, or encoded by an isolated nucleic acid sequence from BP1650 bacteriophage of the invention. BP1650 bacteriophage of the invention is also characterized by a PLE below 20, more preferably below 15 and still more preferably of around 14.

In still another aspect, the invention is related to BP1658 bacteriophage, or any variant thereof. BP1658 bacteriophage, or any variant thereof, can be produced or expanded in e.g., *P. aeruginosa* strain PAO1. BP1658, or any variant thereof, is specific for and has lytic activity against LMG24882, LMG24887, LMG24891, LMG24893, LMG24896 and/or LMG24898 strains. BP1658 comprises a genome comprising a sequence as set forth in SEQ ID NO: 11 or having at least 80% identity, more preferably at least 85% identity, and still more preferably 90%, 92%, 94%, 95%, 96%, 97%, 98% or 99% identity to SEQ ID NO: 11. It is also provided an isolated nucleic acid sequence from BP1658 bacteriophage, or variant thereof. The invention also encompasses isolated polypeptides encoded by BP1658 bacteriophage, or variant thereof, or encoded by an isolated nucleic acid sequence from BP1658 bacteriophage of the invention. BP1658 bacteriophage of the invention is also characterized by a PLE below 20, more preferably below 15 and still more preferably of around 3.

In another aspect, the invention is related to BP1661 bacteriophage, or any variant thereof. BP1661 bacteriophage, or any variant thereof, can be produced or expanded in e.g., *P. aeruginosa* strain PAO1. BP1661 or any variant thereof, is specific for and has lytic activity against LMG24882, LMG24883, LMG24886, LMG24891, LMG24892, LMG24893, LMG24896, LMG24898, and/or LMG24909 strains. BP1661 comprises a genome comprising a sequence as set forth in SEQ ID NO: 12 or having at least 80% identity, more preferably at least 85% identity, and still more preferably 90%, 92%, 94%, 95%, 96%, 97%, 98% or 99% identity to SEQ ID NO: 12. It is also provided an isolated nucleic acid sequence from BP1661 bacteriophage, or variant thereof. The invention also encompasses isolated polypeptides encoded by BP1661 bacteriophage, or variant thereof, or encoded by an isolated nucleic acid sequence from BP1661 bacteriophage of the invention. BP1661 bacteriophage of the invention is also characterized by a PLE below 20, more preferably below 15 and still more preferably of around 4.

In still another aspect, the invention is related to BP1662 bacteriophage, or any variant thereof. BP1662 bacteriophage, or any variant thereof, can be produced or expanded in e.g., *P. aeruginosa* strain PAO1. BP1662 or any variant thereof, is specific for and has lytic activity against LMG24883, LMG24891, LMG24892, LMG24893, LMG24896, LMG24898, and/or LMG24916 strains. BP1662 comprises a genome comprising a sequence as set forth in SEQ ID NO: 13 or having at least 80% identity, more preferably at least 85% identity, and still more preferably 90%, 92%, 94%, 95%, 96%, 97%, 98% or 99% identity to SEQ ID NO: 13. It is also provided an isolated nucleic acid sequence from BP1662 bacteriophage, or variant thereof. The invention also encompasses isolated polypeptides encoded by BP1662 bacteriophage, or variant thereof, or encoded by an isolated nucleic acid sequence from BP1662 bacteriophage of the invention. BP1662 bacteriophage of the invention is also characterized by a PLE below 20, more preferably below 15 and still more preferably of around 1.

Nucleic Acids and Polypeptides

The invention relates to a nucleic acid contained in a bacteriophage of the invention, or any fragment of such a nucleic acid. The term fragment designates, more preferably, a fragment containing (or consisting of) an open reading frame. The nucleic acid may be DNA or RNA, single- or double-stranded.

The nucleic acid can be isolated from the deposited bacteriophages, or produced using recombinant DNA technology (e.g., polymerase chain reaction (PCR) amplification, cloning), enzymatic or chemical synthesis, or combinations thereof, according to general techniques known per se in the art. Also included are homologous sequences and fragments thereof including, but not limited to, natural allelic variants and modified nucleic acid sequences in which nucleotides have been inserted, deleted, substituted, and/or inverted.

In a particular embodiment, the invention relates to a nucleic acid comprising a sequence selected from any one of SEQ ID NOs: 1-13, or a sequence having at least 95%, 96%, 97%, 98%, 99% or more sequence identity to any one of SEQ ID NOs: 1-13.

In another particular embodiment, the invention relates to a nucleic acid comprising the sequence of a fragment of a sequence selected from any one of SEQ ID NOs: 1-13, or a fragment of a sequence having at least 95%, 96%, 97%, 98%, 99% or more sequence identity to any one of SEQ ID NOs: 1-13, said fragment comprising an open reading frame or a regulatory element such as a promoter.

The nucleic acid of the invention can be in free form, or cloned in a vector.

In a further aspect, the invention also relates to an isolated polypeptide encoded by a nucleic acid sequence selected from SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12 and SEQ ID NO: 13. The polypeptides may be produced by techniques known per se in the art such as synthesis, recombinant technology, or combinations thereof. The polypeptides may be isolated or purified, and used as antibacterial agents or as reagents for in vitro analyses.

Compositions of the Invention

One aspect of the invention relates to compositions comprising at least one bacteriophage as described above, more preferably at least 2 or more and, optionally, a pharmaceutically or veterinary acceptable excipient. As described, the bacteriophages of the invention have very potent lytic activity against P. aeruginosa strains. Combinations of these bacteriophages may be produced to expand the host spectrum and produce highly effective antibacterial compositions.

More particularly, the invention relates to an antibacterial composition comprising at least two bacteriophages having lytic activity against a Pseudomonas aeruginosa (P. aeruginosa) strain, said at least two bacteriophages being selected from the bacteriophages having a genome comprising a nucleotide sequence of any one of SEQ ID NOs: 1 to 13 or a sequence having at least 90% identity thereto, preferably at least 91%, 92%, 93%, 94%, 95%, 96%, 97%, 98% or 99% identity thereto.

In a preferred embodiment, the compositions of the invention comprise at least three, even more preferably at least four distinct bacteriophages selected from the bacteriophages having a genome comprising a nucleotide sequence of any one of SEQ ID NOs: 1 to 13 or a sequence having at least 90% identity thereto, preferably at least 91%, 92%, 93%, 94%, 95%, 96%, 97%, 98% or 99% identity thereto. Compositions of the invention may comprise at least 5, 6, 7, 8, 9, 10, 11, 11, 12 or all of the 13 distinct types of bacteriophages as disclosed above.

One aspect of the invention is related to a composition at least one bacteriophage selected from BP1384, BP1429, BP1430, BP1433, BP1450, BP1644, BP1647, BP1648, BP1649, BP1650, BP1658, BP1661 and/or BP1662, or variants thereof.

The invention also concerns a composition comprising at least two distinct bacteriophages selected from BP1384, BP1429, BP1430, BP1433, BP1450, BP1644, BP1647, BP1648, BP1649, BP1650, BP1658, BP1661 and/or BP1662, or variants thereof.

In a particular embodiment, a composition of the invention comprises BP1384 in combination with at least one further bacteriophage selected from BP1429, BP1430, BP1433, BP1450, or BP1644.

In another particular embodiment, a composition of the invention comprises BP1384 in combination with at least one further bacteriophage selected from BP1450 and BP1647.

In another particular embodiment, a composition of the invention comprises BP1430 in combination with at least one further bacteriophage selected from BP1450, BP1644, BP1649 and BP1661.

In another particular embodiment, the composition comprises BP1433 in combination with at least one further bacteriophage selected from BP1450, BP1647, BP1648, BP1650 and BP1658.

In another preferred embodiment, the composition comprises BP1384 in combination with at least one further bacteriophage selected from BP1429, BP1647, BP1649 and BP1662.

The invention also relates to a composition comprising a combination of all of the bacteriophages BP1384, BP1429, BP1430, BP1433, BP1450, BP1644, BP1647, BP1648, BP1649, BP1650, BP1658, BP1661 and/or BP1662, or variants thereof.

Specific examples of compositions of the invention comprise:

a bacteriophage having a genome comprising a nucleotide sequence of SEQ ID NO: 1 or a sequence having at least 90% identity thereto, and a bacteriophage having a genome comprising a nucleotide sequence of SEQ ID NO: 4 or a sequence having at least 90% identity thereto;

a bacteriophage having a genome comprising a nucleotide sequence of SEQ ID NO: 1 or a sequence having at least 90% identity thereto, and a bacteriophage having a genome comprising a nucleotide sequence of SEQ ID NO: 5 or a sequence having at least 90% identity thereto;

a bacteriophage having a genome comprising a nucleotide sequence of SEQ ID NO: 3 or a sequence having at least 90% identity thereto, and a bacteriophage having a genome comprising a nucleotide sequence of SEQ ID NO: 9 or a sequence having at least 90% identity thereto;

a bacteriophage having a genome comprising a nucleotide sequence of SEQ ID NO: 3 or a sequence having at least 90% identity thereto, and a bacteriophage having a genome comprising a nucleotide sequence of SEQ ID NO: 4 or a sequence having at least 90% identity thereto;

a bacteriophage having a genome comprising a nucleotide sequence of SEQ ID NO: 3 or a sequence having at least 90% identity thereto, and a bacteriophage having a genome comprising a nucleotide sequence of SEQ ID NO: 10 or a sequence having at least 90% identity thereto;

a bacteriophage having a genome comprising a nucleotide sequence of SEQ ID NO: 1 or a sequence having at least 90% identity thereto, and a bacteriophage having a genome comprising a nucleotide sequence of SEQ ID NO: 3 or a sequence having at least 90% identity thereto, and a bacteriophage having a genome comprising a nucleotide sequence of SEQ ID NO: 4 or a sequence having at least 90% identity thereto;

a bacteriophage having a genome comprising a nucleotide sequence of SEQ ID NO: 1 or a sequence having at least 90% identity thereto, and a bacteriophage having a genome comprising a nucleotide sequence of SEQ ID NO: 3 or a sequence having at least 90% identity thereto, and a bacteriophage having a genome comprising a nucleotide sequence of SEQ ID NO: 5 or a sequence having at least 90% identity thereto; or a bacteriophage having a genome comprising a nucleotide sequence of SEQ ID NO: 1 or a sequence having at least 90% identity thereto, and a bacteriophage having a genome comprising a nucleotide sequence of SEQ ID NO: 3 or a sequence having at least 90% identity thereto, and a bacteriophage having a genome comprising a nucleotide sequence of SEQ ID NO: 9 or a sequence having at least 90% identity thereto.

A specific embodiment of the invention relates to a composition comprising:

a bacteriophage having a genome comprising a nucleotide sequence of SEQ ID NO: 1 or a sequence having at least 90% identity thereto;

a bacteriophage having a genome comprising a nucleotide sequence of SEQ ID NO: 2 or a sequence having at least 90% identity thereto;

a bacteriophage having a genome comprising a nucleotide sequence of SEQ ID NO: 3 or a sequence having at least 90% identity thereto;

a bacteriophage having a genome comprising a nucleotide sequence of SEQ ID NO: 4 or a sequence having at least 90% identity thereto;

a bacteriophage having a genome comprising a nucleotide sequence of SEQ ID NO: 5 or a sequence having at least 90% identity thereto;

a bacteriophage having a genome comprising a nucleotide sequence of SEQ ID NO: 6 or a sequence having at least 90% identity thereto;

a bacteriophage having a genome comprising a nucleotide sequence of SEQ ID NO: 7 or a sequence having at least 90% identity thereto;

a bacteriophage having a genome comprising a nucleotide sequence of SEQ ID NO: 8 or a sequence having at least 90% identity thereto;

a bacteriophage having a genome comprising a nucleotide sequence of SEQ ID NO: 9 or a sequence having at least 90% identity thereto;

a bacteriophage having a genome comprising a nucleotide sequence of SEQ ID NO: 10 or a sequence having at least 90% identity thereto;

a bacteriophage having a genome comprising a nucleotide sequence of SEQ ID NO: 11 or a sequence having at least 90% identity thereto;

a bacteriophage having a genome comprising a nucleotide sequence of SEQ ID NO: 12 or a sequence having at least 90% identity thereto; and a bacteriophage having a genome comprising a nucleotide sequence of SEQ ID NO: 13 or a sequence having at least 90% identity thereto.

The compositions of the invention may further comprise additional antibacterial agents, particularly other bacteriophages having distinct host specificity.

Preferred compositions of the invention are lytic against antibiotic-resistant *P. aeruginosa* strains.

Further preferred compositions of the invention are lytic against more that 90% of all bacterial strains of the LMG collection, obtained from the well-known BCCM/LMG Bacteria Collection. This collection is accessible via Worldwide Website: cabri.org/CABRI/srs-doc/bccm_lmg.info.html.

The antibacterial compositions of the invention may be in various forms, such as liquid, semi-liquid, solid or lyophilized formulations.

The compositions of the invention may comprise any effective amount of the selected bacteriophage(s). Preferably, they comprise between $10^{e4}$ and $10^{e12}$ PFU of each of said bacteriophages, preferably between $10^{e5}$ and $10^{e10}$ PFU. The relative amounts of each type of bacteriophage in a composition of the invention may be adjusted by a skilled artisan. Typically, when the antibacterial composition comprises several (n) distinct bacteriophages as defined above, the total relative amount % A of each bacteriophage in the composition is more preferably % $A=(100/n_i) \times V$, wherein $n_i$ represents the number of distinct types of bacteriophages and V is a variability factor comprised between 0.2 and 5. Most preferably, V is comprised between 0.3 and 3, even more preferably between 0.5 and 2, generally between 0.8 and 1.5. In a preferred typical embodiment, each type of bacteriophage is present in a composition of the invention in approximately equal relative amounts.

The compositions of the invention preferably comprise a suitable diluent or carrier, such as a pharmaceutically or veterinary acceptable excipient or carrier. Compositions according to the present invention may include any excipient or carrier, such as thickeners, diluents, buffers, preservatives, surface active agents and the like, in addition to the bacteriophage(s) of choice. Such includes physiologically acceptable solutions or vehicles that are harmless or do not cause any significant specific or non-specific immune reaction to an organism or do not abrogate the biological activity of the bacteriophage. For liquid formulation, saline, sterile water, Ringer's solution, buffered physiological saline, albumin infusion solution, dextrose solution, maltodextrin solution, glycerol, ethanol, and mixtures thereof may be used as a pharmaceutically or veterinary acceptable excipient or carrier. If appropriate, other conventional additives such as thickeners, diluents, buffers, preservatives, surface active agents, antioxidants and bacteriostatic agents may be added. Further, diluents, dispersants, surfactants, binders and lubricants may be additionally added to the composition to prepare injectable formulations such as aqueous solutions, suspensions, and emulsions, oral formulations such as pills, capsules, granules, or tablets, or powdered formulations. Formulations for topical administration may include, band aids, dressings, patches, films, ointments, lotions, creams, gels, drops, suppositories, sprays, tampons, sanitary towels, liquids and powders. Formulations for decontamination or for medical use may also include aerosols or sprays.

The compositions of the invention may be used in the medical field, including the human or veterinary medical areas, for e.g. the treatment of an infection in a mammal or for improving a subject's condition. The compositions may be used to kill *P. aeruginosa* bacteria in an organism, for treating an infection. The composition may also be used for improving the condition of a mammal by modifying the microbial flora in said mammal. In particular, the compositions of the invention can specifically remove *P. aeruginosa* strains on the skin or mucous membranes of a mammal, thus modifying its microbial flora and restoring a proper balance.

In a particular embodiment, the invention also relates to a method for treating an infection in a mammal comprising the administration to said mammal of a composition or bacteriophage or nucleic acid or polypeptide as defined above. In a particular embodiment the method comprises administering at least one, preferably at least two, even more preferably at least three bacteriophages selected from BP1384, BP1429, BP1430, BP1433, BP1450, BP1644, BP1647, BP1648, BP1649, BP1650, BP1658, BP1661 and/or BP1662, or variants thereof.

The invention also relates to the use of a composition, bacteriophage, nucleic acid or polypeptide as described for the manufacture of a medicament for treating an infection in a mammal, or for restoring microbial flora in said mammal.

The compositions or agents of the invention may be administered by any convenient route, including intravenous, oral, transdermal, subcutaneous, mucosal, intramuscular, intrapulmonary, intranasal, parenteral, rectal, vaginal and topical. In a preferred embodiment, the bacteriophages or compositions are administered by topical route, e.g., by application on the skin of a subject. The compositions may be administered directly or indirectly, e.g., via a support. In this regard, the compositions may, for example, be applied or sprayed to the afflicted area. Compositions of the invention can also be administered by oral or parenteral routes. The dosage suitable for applying, spraying, or administering the compositions of the present invention can be adjusted by the skilled person depending on a variety of factors including formulation, mode of administration, age, weight, sex, condition, diet of the mammal being treated at the time of administration, route of administration, and reaction sensitivity. A physician having ordinary skill in the art can readily determine and prescribe the effective amount of the composition required.

The dosing can also be adjusted by the skilled person so that a lytic activity against antibiotic-resistant *P. aeruginosa* strains is obtained. An efficient dose to obtain a lytic activity in vivo typically includes a concentration of at least $10^{e2}$ PFU/ml, preferably from about $10^{e2}$ to $10^{e12}$ PFU/ml, depending on the administration route. Administration may be performed only once or, if needed, repeated.

The compositions of the invention may be administered to treat *P. aeruginosa* infections, typically of the respiratory tract, urinary tract, burns, wounds, ear, skin, or soft tissues, or gastrointestinal or post-surgical infections.

As shown in the Examples section, the bacteriophages and compositions of the invention are able to selectively kill *P. aeruginosa* bacteria in vitro or in vivo. The compositions can destroy mixtures of different *P aeruginosa* bacteria, even in vivo, even at low dosage. Furthermore, the compositions of the invention are effective at killing bacteria embedded in biofilms, which is particularly important for pathogenic bacteria. Also, the compositions and bacteriophages of the invention are strictly unable to affect mammalian cells, and are therefore specific and devoid of side effects in vivo.

The invention also relates to the use of a composition, bacteriophage, nucleic acid or polypeptide of the invention for decontaminating a material. Due to their potent antibacterial effect, and to their ability to even compromise the integrity of a bacterial biofilm, the compositions of the invention can be used as decontaminating agent, to eliminate or at least cause a reduction in bacterial numbers on a material. Such methods may be applied for the treatment of a variety of biological or non-biological surfaces in both medical and non-medical contexts, including solid materials or devices such as, for example, contact lenses, surfaces of devices to be implanted into the body, pipes, ducts, laboratory vessels, textiles, etc.

Diagnostic/Predictive Tests of the Invention:

The invention also concerns a method for predicting or determining the efficacy of a bacteriophage therapy in a subject, wherein the method comprises a step of determining a lytic activity of one or more bacteriophages selected from BP1384, BP1429, BP1430, BP1433, BP1450, BP1644, BP1647, BP1648, BP1649, BP1650, BP1658, BP1661 and/or BP1662 to a *P. aeruginosa* strain from a sample from said subject, such lytic activity being indicative of an efficient treatment. In a preferred aspect, the method further optionally comprises a step of treating said subject by one or more bacteriophages having a lytic activity to a *P. aeruginosa* strain from a sample of said subject.

In another aspect, the invention provides a method for selecting a subject or determining whether a subject is susceptible to benefit from a bacteriophage therapy, wherein the method comprises the step of determining a lytic activity of one or more bacteriophages selected from BP1384, BP1429, BP1430, BP1433, BP1450, BP1644, BP1647, BP1648, BP1649, BP1650, BP1658, BP1661 and/or BP1662 to a *P. aeruginosa* strain from a sample of said subject, a lytic activity of one or more bacteriophages of the invention to at least one *P. aeruginosa* strain indicating a responder subject.

Another object of the invention relates to a method for predicting the response of a subject to a bacteriophage therapy, wherein the method comprises the step of determining a lytic activity of one or more bacteriophage selected from BP1384, BP1429, BP1430, BP1433, BP1450, BP1644, BP1647, BP1648, BP1649, BP1650, BP1658, BP1661 and/or BP1662 to a *P. aeruginosa* strain from a sample of said subject, a lytic activity of one or more bacteriophage of the invention to at least one *P. aeruginosa* strain being indicative of a good response to said therapy.

Further aspects and advantages of the invention will be disclosed in the following experimental section, which is illustrative only.

EXAMPLES

Materials and Methods
Phage Isolation and Preparation

MDR *P. aeruginosa* bacteria were used for isolating and enriching each virulent bacteriophage from environmental water. Environmental samples and overnight culture of bacteria in Luria Bertani (LB) were mixed and incubated at 37° C. for 24 h with shaking to enrich specific bacteriophages. At the end of incubation, drops of chloroform were added to the culture. The culture was spun down at 11,000 g for 5 minutes to remove bacterial cells and debris. The supernatant was subjected to 0.2 µm filter to remove the residual bacterial cells. The enriched phage solution was plated on LB agar medium with *P. aeruginosa* embedded. Plaques formed on the plates after 24 h incubation at 37° C. Single plaque was picked out for subsequent phage purification and amplification. The phage was then stored at 4° C. in a suspension in LB broth or physiological saline.

The titer of phage in a suspension was estimated by plaque counting (Postic, 1961). 10-fold dilutions of a suspension were delivered on a dried lawn of the propagating strain. The plates were read after overnight incubation. The plaque-counting method also permitted visualization of plaque morphology.

Host Range Determination

The host ranges of bacteriophages were determined among a collection of 20 *P. aeruginosa* from the LMG collection. $10^9$ bacterial cells were mixed with melted agar and this mixture was poured on solid agar to make double layer agar plates. After solidification, isolated bacteriophage stock solutions were spotted on each plate with different bacterium strain. After allowing 20 min for the spots to be absorbed, the plates were inverted and incubated for 24 h at 37° C. before the degree of lysis was recorded (Postic, 1961; Yang, 2010).

Electron Microscopy

Electron micrographs of each phage were taken with a transmission electron microscope.

Sequencing, Analysis and Annotation of Phage Genomes

To isolate phage DNA, phages were propagated as described above. Phage DNA was isolated by extraction with phenol:chloroform:isoamyl alcohol (25:24:1, V/V), ethanol precipitation and resolution in water. Whole genome sequencing was done and the BLAST algorithm was used to determine the similarity to described genes in the National Center for Biotechnology Information (NCBI) database. The genomes were scanned for potential open reading frames (ORFs).

Example 1: Bacteriophage-Host Characteristics and Kinetics

One-step growth experiments were carried out according to the previous descriptions to determine first the productive lytic time, adsorption rate then the phage burst size. To determine the adsorption rate samples were taken at different time intervals to analyze the free phage particles in the solutions. For productive time and phage burst size determination, *P. aeruginosa* bacteria were mixed with phage solutions and phages were allowed to adsorb for 15 min. The mixture was subjected to centrifugation immediately at 5000 rpm for 10 min to remove free phage particles. The pellet was resuspended in 5 fresh LB medium and the culture was continuously incubated at 37° C. Samples were taken at 3 min intervals and phage titre was determined. These results permitted to calculate the number of phages produced per bacteria (burst size), the productive time and the productive lytic effect (PLE), as shown in Table 5 below.

TABLE 4

| Phage | Productive lytic time (min) | Adsorption rate (ml-1min-1) | BURST SIZE (PFU per bacterium) | PLE (PFU per bacterium per min) |
|---|---|---|---|---|
| 1384 | 80 | 8.64E−09 | 499 | 6.24 |
| 1429 | 70 | 9.16E−09 | 49 | 0.70 |
| 1430 | 60 | 1.66E−08 | 166 | 2.76 |
| 1433 | 100 | 2.72E−09 | 399 | 3.99 |
| 1450 | 100 | 1.07E−08 | 199 | 1.99 |
| 1644 | 70 | 8.35E−09 | 99 | 1.41 |
| 1647 | 90 | 2.34E−08 | 32 | 0.36 |
| 1648 | 100 | 2.70E−09 | 199 | 1.99 |
| 1649 | 100 | 1.10E−08 | 332 | 3.32 |
| 1650 | 70 | 3.47E−09 | 999 | 14.27 |
| 1658 | 90 | 1.61E−08 | 249 | 2.77 |
| 1661 | 90 | 7.11E−09 | 332 | 3.69 |
| 1662 | 90 | 9.16E−09 | 99 | 1.10 |

These results show that all phages have potent viral production capacity and absorption rates. Most phages have a PLE below 7, which demonstrates a remarkable profile. Phages 1429 and 1647 are particularly effective in this regard. In addition, the different PLE and adsorption times permit to create cocktails with selected variability.

Example 2: Preparation of Cocktail Compositions

The following cocktail compositions are constituted, each comprising between 10-9 and 10-11 pfu of each bacteriophage:

TABLE 5

| Cocktail | Phages |
|---|---|
| I | P1384 + P1433 |
| II | P1384 + P1450 |
| III | P1430 + P1649 |
| IV | P1430 + P1433 |
| V | P1430 + P1650 |
| VI | P1384 + P1430 + P1433 |
| VII | P1384 + P1430 + P1450 |
| VIII | P1384 + P1430 + P1649 |

The following additional two cocktail compositions comprising all of the various phages are constituted, covering the most important diversity of *P. aeruginosa* species:

Cocktail Composition A:

| | Phage | | | | | | | |
|---|---|---|---|---|---|---|---|---|
| | 1384 | 1429 | 1430 | 1433 | 1450 | 1644 | 1647 | 1648 |
| titer | 4.00E+10 | 1.23E+09 | 5.45E+08 | 8.33E+10 | 8.91E+10 | 9.09E+08 | 2.00E+09 | 3.09E+09 |

| | Phage | | | | |
|---|---|---|---|---|---|
| | 1649 | 1650 | 1658 | 1661 | 1662 |
| Titre | 9.00E+09 | 9.45E+08 | 1.91E+09 | 1.14E+09 | 3.55E+08 |

Cocktail Composition B:

| | phage | | | | | | | |
|---|---|---|---|---|---|---|---|---|
| | 1384 | 1429 | 1430 | 1433 | 1450 | 1644 | 1647 | 1648 |
| Titre | 1.60E+11 | 2.00E+11 | 2.00E+11 | 1.20E+11 | 8.00E+10 | 1.00E+11 | 1.00E+08 | 1.00E+09 |

| | phage | | | | |
|---|---|---|---|---|---|
| | 1649 | 1650 | 1658 | 1661 | 1662 |
| Titre | 1.00E+11 | 2.20E+11 | 8.00E+10 | 1.00E+11 | 6.00E+07 |

Example 3: Sensitivity of Bacteria to Bacteriophage Cocktails of the Invention

Various strains of bacteria were tested with the bacteriophage cocktails of the invention at $2.10^9$ bacteriophages/ml. Different bacterial concentrations were plated on the bacteriophage cocktail at $2.10^9$ bacteriophages/ml and incubated 24 h at 37° C.

Cocktails are tested on the 22 distinct *P. aeruginosa* bacteria listed in Tables 2 and 3. The % of bacteria species sensitive to the cocktails are listed in Table 6 below:

TABLE 6

| Cocktail | % Killed *P. aeruginosa* species |
|---|---|
| I | 73% |
| II | 82% |
| III | 91% |
| IV | 86% |
| V | 77% |
| VI | 86% |
| VII | 95% |
| VIII | 95% |
| A | 100% |
| B | 100% |

Bacteria were enumerated and used to the calculation of resistance rate (number of bacteria after incubation/number of bacteria plated). Resistance rates with a cocktail comprising the 13 different types of bacteriophages are shown in Table 7 below:

TABLE 7

| Bacteria | Rate (bacteria/ml) |
|---|---|
| LMG 24891 | 1.00E–05 |
| LMG 24945 | 5.80E–06 |
| LMG 24970 | 1.00E–05 |
| LMG 25082 | 4.60E–06 |
| LMG 25131 | 9.00E–06 |
| LMG 25194 | 9.00E–06 |

All tested bacteria are sensitive to compositions of the invention.

Example 4: Cocktail Specificity

The cocktail specificity was confirmed by testing on ten bacteria species, including *Escherichia coli*, *Acinetobacter baumannii*, *Enterobacter aerogenes* C, *Enterobacter asburiae*, *Enterobacter cloacae*, *Klebsiella pneumoniae*, *Proteus Staphylococcus aureus*, *Stenotrophomonasmaltophilia*, and *Serratia marcescens*.

Table 8 summarizes lytic activity observed for each bacteriophage used independently or in combination as a cocktail of 13 bacteriophages.

| | Phage PYO | 1384 | 1429 | 1430 | 1433 | 1450 | 1644 | 1647 | 1648 | 1649 | 1650 | 1658 | 1661 | 1662 | Cocktail 13 phages |
|---|---|---|---|---|---|---|---|---|---|---|---|---|---|---|---|
| *Pseudomonas aeruginosa* | SH 85 | | +/– | | | +/– | +/– | | + | +/– | +/– | +/– | + | | + |
| | SH 224 | | | | | + | | | | | | + | +/– | + | + |
| *E. coli* | SH 213 | | | | | | | | | | | | | | – |
| | SH 141 | | | | | | | | | | | | | | – |
| *Acinebacter baumanii* | SH 32 | | | | | | | | | | | | | | – |
| | SH 34 | | | | | | | | | | | | | | – |
| *Enterobacter aerogenes* C | SH 97 | | | | | | | | | | | | | | – |
| | SH 98 | | | | | | | | | | | | | | – |
| *Enterobacter asburiae* | SH 74 | | | | | | | | | | | | | | – |
| *Enterobacter cloacae* | SH 111 | | | | | | | | | | | | | | – |
| | SH 121 | | | | | | | | | | | | | | – |
| *Enterobacter amnigenus* | SH 26 | | | | | | | | | | | | | | – |
| *Klebsiella pneumoniae* | SH 89 | | | | | | | | | | | | | | – |
| | SH 283 | | | | | | | | | | | | | | – |
| *Proteus mirabilis* | SH 82 | | | | | | | | | | | | | | – |
| *S. aureus* (meti R) | SH 14 | | | | | | | | | | | | | | – |
| | SH 129 | | | | | | | | | | | | | | – |
| *Stenotrophomonas maltophila* | SH 286 | | | | | | | | | | | | | | – |
| | SH 290 | | | | | | | | | | | | | | – |
| *Serratia marcescens* | SH 314 | | | | | | | | | | | | | | – |

The above table clearly show that no lytic activity on bacteria other than *P. aeruginosa* strain occurred. The bacteriophages and cocktail of the invention are therefore highly specific for *P. aeruginosa* strains.

Example 5: Efficiency of Bacteriophages on *P. aeruginosa* Strain In Vitro

Several strains of the LMG collection were chosen to represent the genetic diversity of *P. aeruginosa* and various forms of antibiotic resistance. Strains were either sensitive or resistant to one or several antibiotics, as described in Table 9. They were grown individually or in combination with 2 to 8 strains. The bacteriophage cocktail was added at an MOI of 1 to $10^{e-6}$, i.e. at a dilution ratio (bacteria/phage) of 1 to 1 million.

TABLE 9 information about the bacterial strains

| LMG no | Country | Year | Source | Sero-type | Class ATB resistance |
|---|---|---|---|---|---|
| LMG 24891 | France | 1882-1918 | Surgical bandage | 11 | 1 |
| LMG 24893 | Greece | 1994 | Sputum | 11 | 2 |
| LMG 24909 | Colombia | 2003 | Peritoneal fluid | 12 | 0 |
| LMG 24988 | Turkey | 1997 | Burn | 8 | 3 |
| LMG 24992 | UK | 2003 | CF-patient | NT | 4 |
| LMG 25041 | The Philippines | 1993 | Wound | NT | 2 |
| LMG 25049 | France | 1882-1918 | Wound | 6 | 1 |
| LMG 25140 | Panama | 2006 | Wound | 11 | 5 |

The results are presented in FIG. 1 and in Table 10.

TABLE 10

Efficiency of bacteriophage cocktail obtained in vitro on *P. aeruginosa* mixture: at $2.10^{e7}$ cfu/ml and at various dilutions:

| | Mix of: | | | | | |
|---|---|---|---|---|---|---|
| | MOI 1 | MOI 0.1 | MOI 0.01 | MOI 0.001 | MOI 0.0001 | MOI 0.000001 |
| 1 bacterium | ++ | ++ | ++ | ++ | ++ | ++ |
| 2 bacteria | ++ | ++ | ++ | ++ | ++ | ++ |
| 3 bacteria | ++ | ++ | + | + | + | + |
| 4 bacteria | ++ | ++ | + | +/− | +/− | +/− |
| 5 bacteria | ++ | + | + | +/− | +/− | |
| 6 bacteria | ++ | + | + | +/− | +/− | |
| 7 bacteria | ++ | + | + | +/− | +/− | |
| 8 bacteria | ++ | + | +/− | +/− | | |

The compositions of the invention are able to kill a mixture of 8 distinct strains of *P. aeruginosa* bacteria together. The cocktail remains efficient against 8 strains at a dilution of 1/1000.

Example 6: Efficiency of Bacteriophages on *P. aeruginosa* Strain In Vivo

An isolated Is580 strain, collected from a burned patient in 1997, was used for the following experiments.

Is580 strain is resistant to ampicillin, AMC, PIP, CEF, CXM, axetil CXM, FOX, CPD, CTX, CAZ, GEN, TOB, OFX, NIT, and SXT.

SKH1 mouse (or hairless mouse) was used as mouse model of *P. aeruginosa* infection.

Modus operandi: (see Table 11 below):
Mice were immunodepressed by 3 IP injections of 1.5 mg of cyclophosphamide (Cy), every 2 days from Day −3 before infection.
Mice were burned on skin by 2 μl of liquid yperite at 30 mg/kg.
Infection two days after the burn by subcutaneous injection of a bacterium suspension in burned site.

TABLE 11

| | Day | | | | |
|---|---|---|---|---|---|
| | −3 | −2 | −1 | 0 | 1 |
| Injection route | 1.5 mg Cy IP | Burn Yperite | 1.5 mg Cy IP | Infection SC $10^7$ cfu | 1.5 mg Cy IP |
| PHAGE | | | | SC injection of cocktail (100 μl, i.e. $10^8$ PFU) 6 h post-infection | |

Cocktail compositions were prepared according to Example 1 and compresses soaked of bacteriophages cocktail at $10^{e7}$ phages/ml were applied at Day 0.

Figure 2:
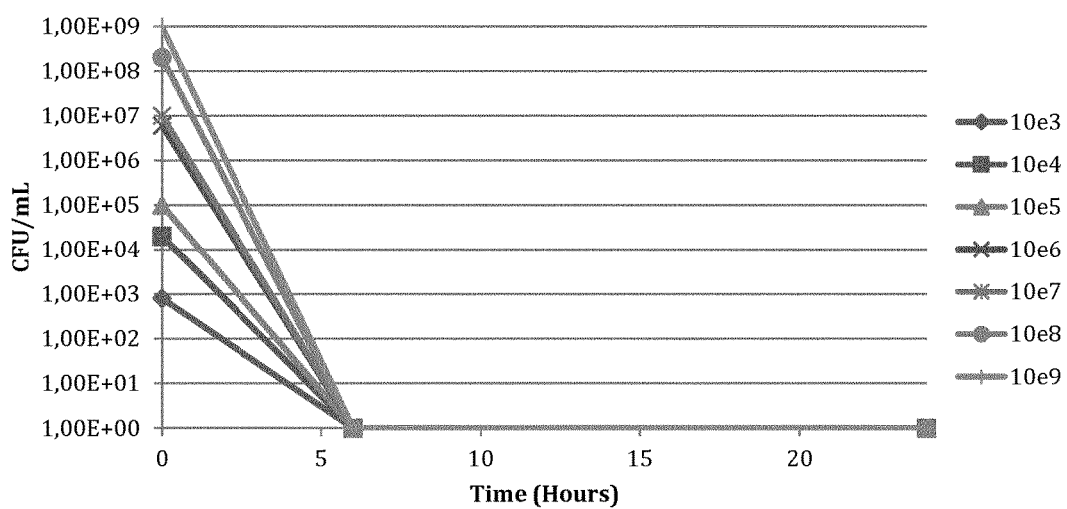
FIG. 2: In vivo efficacy of Bacteriophages of the invention on various combinations of *P. aeruginosa* strains.

Various concentrations of *P. aeruginosa* strains were tested with 100 μl of bacteriophage cocktail. As shown on FIG. 2, all *P. aeruginosa* strains were killed 6 h post-treatment.

Figure 3:
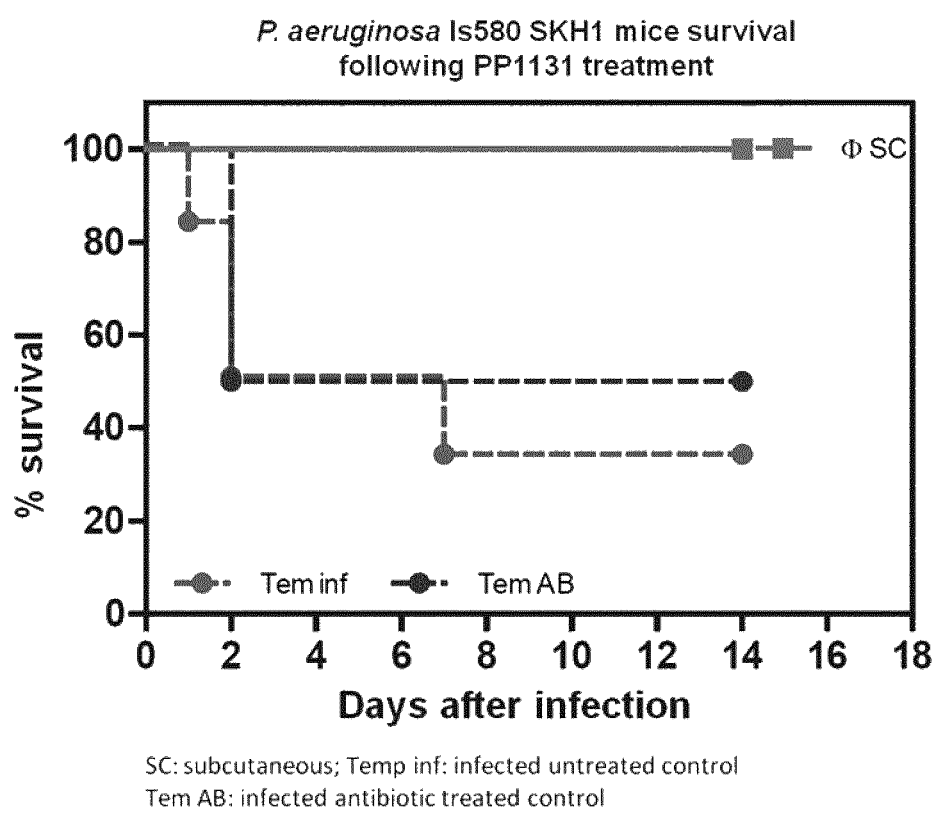
FIG. 3: Efficacy of bacteriophages of the invention in vivo on Is580 *P. aeruginosa* strain-mediated infection.

Upon administration of Is580 *P. aeruginosa* strain by subcutaneous injection to SKH1 mice, only 35% of mice survived in the absence of further treatment. In the mice treated by injection of a bacteriophage cocktail as presented in Table 10 above, a remarkable survival rate was observed (see FIG. 3): 100% survival for SKH1 mice treated subcutaneously, 16 days after infection. By comparison, a 50% survival was observed for SKH1 mice treated by antibiotic 2 days after infection.

Accordingly, the compositions of the invention can treat an infection in vivo and can induce a 100% survival rate in infected mice.

REFERENCES

Clark W A, 1962, Appl Microbiol. Comparison of several methods for preserving bacteriophages. 1962 September; 10:466-71.

Drulis-Kawa Z, Majkowska-Skrobek G, Maciejewska B, Delattre A S, Lavigne R, 2012, Learning from bacteriophages—advantages and limitations of phage and phage-encoded protein applications. Curr. Protein Pept. Sci. 13(8):699-722.

Fordos J. 1859. Receuil des travaux de la Societe d'Emulation pour les Sciences Pharmaceutiques, vol 3 Societe d'Emulation pour les Sciences Pharmaceutiques, Paris, France.

Freeman L. 1916. Chronic general infection with the *Bacillus pyocyaneus*. Ann. Surg. 64:195-202.

Gang R K, Bang R L, Sanyal S C, Mokaddas E, Lari A R. 1999. *Pseudomonas aeruginosa* septicaemia in burns. Burns 25:611-616.

Jones A M, et al. 2010. Clinical outcome for cystic fibrosis patients infected with transmissible *Pseudomonas aeruginosa*: an 8-year prospective study. Chest 137:1405-1409.

Kang C I, et al. 2005. Bloodstream infections caused by antibiotic-resistant gram-negative bacilli: risk factors for mortality and impact of inappropriate initial antimicrobial therapy on outcome. Antimicrob. Agents Chemother. 49:760-766.

Micek S T, et al. 2005. *Pseudomonas aeruginosa* bloodstream infection: importance of appropriate initial antimicrobial treatment. Antimicrob. Agents Chemother. 49:1306-1311.

Strateva T. and Yordanov D. 2009. *Pseudomonas aeruginosa*—a phenomenon of bacterial resistance. Journal of Medical Microbiology 58, 1133-1148.

Weinbauer M G. Ecology of prokaryotic viruses. FEMS Microbiol Rev 2004; 28:127-81.

Williams E P, Cameron K. 1894. Infection by the *Bacillus pyocyaneus* a cause of infantile mortality. Public Health Pap. Rep. 20:355-360.

SEQUENCE LISTING (13 sequences)

SEQ ID NO: 1 - DNA, 63902 bp, artificial sequence
  BP1384
  misc_feature (63895)..(63902): n is a, c, g, or t
tcgcgtttcgatgaggagattatgccgatagtcagaatggaagtaaagtgtctgagtgagaaaaattctgcacaccgacgaacggttgtgctcgaccgtctgttgcggcgtcgatatactcggcctattgctaacaccggactgattggaatgtacaaactcaatcctgcgctgcgagcggtctggcgaactcgtgcccgttacaaagtcatctatggcggccgggcgtcttcgaagtcgcacgacgctggcggtatagccgttttcctcgcggccaactacaagctaaagttcctctgtgctcgccagtttcagaaccgcatcagcgaatcggtctacacgttgatcaaggacaagatcgaaaactcagagtataatggcgaattcatcttcaccaagaactctatcaagcacaagagtaccgggtcagagttcctattctatgggatcgcccgtaacctgtcggaaatcaagtccaccgaaggcatcgacattctctggcttgaggaagctcactatctgacccaggagcaatgggaagtcatcgagccgaccatccggaaagagaactcagaaatctggatcatcttcaacccgaacgaagtgaccgacttcgtgtatcagaacttcgtggtcaagcccccgaaagattcctgcgtcaagatgatcaactggaatgaaaatccgttcctcagtgagacgatgcttaaagtcattcacgaagcatatgagcgcgaccgggagcaggccgagcacatttatggcgggattccgaagactggaggcgacaaatccgtcatcaacctcaagttcatcctcgcggccatcgacgcccacaagaaactcggctgggagccagccggatcgaagcgcatcggcttcgacgttgcggacgacggcgatgatgcgaacgccaccacgctcatgcacggaaacgtcataatggaagtggacgaatgggacggcctggaagatgaactgctcaagtcgtccagccgcgtttacaatctggcgaagctgaaaggcgcctcggtcacttatgactccatcggcgtcggcgctcatgtcggttcgaagttcgccgagttgaacgatgccagccccgacttcaaacttatctatgatccattcaacgcgggcggcgctgtcgataagcctgatgatgtctacatgaagctgccgcacacgacgatcaagaacaaagaccacttcagcaacatcaaggcgcagaagtgggaagaagtcgcgacccgattcaggaagacttatgaagcggttgagcatggaaaggtttatccattcgacgaattgatttcgatcaactctgaaacgattcacccggacaaactaaatcaattgtgtattgaactttcgtcgccgcgcaaagacctggacatgaacggccggttcaaagtcgagtccaagaaggatatgcgcgagaaacgcaagatcaagtcaccgaacatcgctgactcggtgattatgtcggccattctgccgatccggaagcccaaaggcttcttcgacttctaaacatagaaaagcccggatcgctccgggcttcgggtcttactcggtgtggttcctggcgctgagtgtcgacgcaacggcctcgccgactcccagggcttcctggccggccgcgagcgcttcggcttccgactcgacgatgaaatcatcaccttggccatcgcctggcggaacctcgaccagcacggcttcttcgccttcgaaccgcaggtcataggtcttttcgacggacagaccgtaacgagcgttgagcgcgtcccagagctgggcctcataggtccgcaggtcttgcagagctttctggtggctgagcatggccatgtcaacagcccgttgcagggtttcgtccaggacgttgaatcgcatgcgaagagaacgaatccgctcgaccacttccgcatccactacatgcctttcgatcatcgcttttcacctttgctgaatgttacgttgtagccgttgtcggccagataggtcaaggcgccttcgaaagaagttccgacaaggtgcttgagctgcatttcgcgttgcgcggcgatccagaatgccgttccggagaactctgcgcggccttccgacaaaacctttccatcaggcccgtcgatccgtacatggacggaagatagcttcagcgccatcagtgaaccgtccctgtgaaggcgcgcgccgccgcgcattgatcgcaagggcactccctctggatgcgcgccaggtcgtttgcatccagggcgtagagttttccatctacggtatcgtgagccattgcgatgtccggatattcgttttcgtccaggccggatgccgcacggatgttgttccagatgccggcatgttccgcgcgatggcgcgcggtcaactcatcttgctctttgttcgccctttcaacgaatttctccaggagttcggtgaatttctcatcgatgactcgtgcagacttgacagagctgagtcgaatcgggtctttcttcatggtgattctcttttgctggtggttgttcgctgcccagacctattcaaagtctgggcagcatgatgaaaatgaacacgaaggctgcaaacgccaatagcgttcctgtaagcattttggcttgactctgcacctcagcgtactgcttagtggacattccgtgctgcgccgcctcggccgcgaagcgagctttcgcctcgataacttccgggcgcagcgacaggacatattctaaggcctcttcccgcgcttttcggcctcgaccaacctagggtcgcgggccgagacttcgctgtgccctggcctcgcgggatgggcctgcagcgatggcggaagttcggcggccacgactccatagtcggcgcaggcccaagcgatcccgatgaggatcgcgaggatggattgaacgattcgtagcatcactttgtcgctagggaagctcatgatcaatcctccacagaccgaacgatttccatgttgcggccggcattggtcccggcattgaaggcgcgccgaccgtcgctatcgtccagacgcatgagcttagcaacattgtacttcttgtagccaggatcgccgaaatgttcgtgaaccgcagcttccttcaccacaaccagagacgttccggcagaagataccagctccatgcgcttcctggttatggcctgaaggcgatagctgatttcctgggtcgcggccagcttgaattgcgcggcaaccttgacgttgaatcgtccgtatccttgagccttctgatactcccggcacagacgatcaaccgcttcgacaagggagttgaacatgttcaccgccagctcaacgtccgatttgtagcctttaaagcggacggcatgaccccagcgcttcgtagtcccgccgtttgcggcgtgccaagaagccttggcggtcgctcggtgatcgttgatgccaccggcgaaatccatgatgaagtcgttgtacgtcgccacggccaccgagaagaacttcatccagttcgggattgcggaatagtaacgagtcgcgatctgctcatcgaactcttcgcaaatctcgccggtcacttcgaagtcgtgaaggtcatatttgtccttcagcttcttcacacgctcggctgcaatggcagcttcgtgcgggctggaggagtcggccgccatggcagtcagtttgcggatgcggtctttcgccttctcgatggcttccggggtgaattcgttctggtaggtcatggtcggttccttttgtctgaagggtttcgcgtttcaatggagctattttgccttcattcagaatggaagtaaagcattttcttccactatttcggcattgactggaagaaattccagatccaatcgcctgctaccagcaggaggatgagagcggcgaagaacaagacggcggccgcgagctgtgcgcccggcttcagcttgggatggctgagcttgggctctacgggaacggccggagcgctggcgctgcaaacggcatctcctggaccgtagccgatgccgcgttcacgcgcctggagcgacaccagggatttcagatgctcggtctgcttttgcgactcttcgtagatgccggcgacggcgaaccagagggcgaacacgacggacgtacacacaacccaggcgccggtcagcaggagggccagcgggccgatgacgaagacggtagcagccaggacgattgcgccgccccagatgatgaagccggccagaccattggcgatgtcgatacagaactttttcatttgcggattccttcggctacaggatggaggggatttggaactctgcgccgccgagcacatcggtgacgacttcccagagcgtcggcaccgaccactggtagcggtcgaagtcggtttcgggatcgaagcccaacgtcacataggaagtggcaggccatttatgaacgctacctttccgcatgagagtcgccacgcgtccgtcaacgagcgggttcgtcttgtgcggaacgtacgcagacatcgaatattgctgcccggcgtcaacaacaaatctttgcctctggcgcagacatacagagcccacaggattccagccgcgaccgccgcaagcctggcgagccgaagagtgttcataaccttcgtgagtcatttcgccgaggcaagccgagcgatcctcgtaatagttgatgttctccatcgatccaaccagtaccagagactcgaaatcgaatctatgatcgtggatggccgagtgattgaagcaaagccggcgcggcaactccgggtgccaaacatggaggcgccctgccgggagctggacttgaatgaaccccaggccgtgcagcgtgatcttgtccttcatcgggtcatggacggtgctcatggataatcctcagtagcagaaatgtatggtgagagttacgatggccaagccggtcgcccataggagggcgaaccaggccatggctttgatggttatgtagatcatccgaagaactttccggcacagatcggtccaatgcccatttcgatggatgcgtggttggtcaactcgcgaccgcagcaggagcattgaccagtcttccggccgtaggcgactgccgattccatcggcttttcaaacatcttcagaacgtcgtcatgctcagtgtcggtgcagtcgcgactcttgatgaatttgccattggtgatccggccgaggtagatgtcgcccaagacgtacaagctaccggcgttccggctgtgagcgctagcctctttcacaataacgatgagcggctcctcgccttcgccagccaggcggattttcgggcgcttgatgccagattctttcgccttctcaaacgccttctcgattccggaaatgtccagagtcggcgcagcagcttcctgcgcggccactttctcgcgatatttggcgaggttttcgatggcgcgcttcgcagcagcgatctgattttctgtcaaggagccgtatttatacaacgactcctgaaggctctgagcgaagctgaaggaatttccagtccaccactcgacgatgtccgggtgcgcatcttcgaaggctttaattttgaggtcgcgctcttgcgccgcgctacagattttctcgatgcgcttttctgccgccttagcacggctcttggcgcgctgctccgggctggttttgtactctttgtatccaacaccgccgcaggcgaagcaggcgcgaccataagacgaagggccacggtacaggccggtgcctgcgcatttggtgcacttgtcgcgatacagcttcacttccttccgggaattcgggcgagcgcccatggacgcgtcttccagggtcttcggcgcttcgttgttgatcgctacggtagcgaagtcgtcacccaggtcttcgaagcctgtgaacagattctctgctgcgttcatatcgattctcctgtttggaaagttcgtttcgatgagttgactatacgccagaaatgggaaaacggtagcactttcgcactaccgttcgtcgggtcgcagagggtcaggctacacggatcaactgcgacatgactgccaggttacgctcggcgacgcctatgatgaggttggttccgatgtcgaacttccaagggtcttccctgttcttgtcgtagaacggatttctgaacagggtccgccatgtctcttcagtgaagaacgttttatggtccaggtcttggtgggcgatgttggagttgtagaatggaacaacgacattgagcgtcgcgccgactgccatggcccgctgcaggtctttcaccaaatcgatgacctgggctccggtgagatgttcgaagaagtgaaatgcgtagaccgccgtcaattcgccgtcttcatacggcactcggccgctggcgccgtcccagttcggccagtcgagcgattcgacgccgggaatcggcgaattgcctgcgcccaggtttactgcgcggcggtgatccggctcgatcaactgagcgatgtcgcgcttcatgccgagtttgaacaggttttgaatatccatttttctctccaggttgctgctagtaaatgtcgctgttgatcttgaatccatgctcagcgccgtcgttgtagtcatactcggcatagctgtcgcagtaatcgttcaaatgttgaatgataccaagaacgtcgttcgcggccttgtgccgtttcgcggcgatggtcttggcgatgctgtcgccgacttccagggtttcggccgtccggcggtggatcagaagacgactccaaagatagagccggacgcgacgaatgatgtcgcgatggcgctccaatcgaacttccaactcttcaagttcttgctcgcgagatttgatgactcgtcgaagctgatgaactttcagttccaaatcgtccttagtagccatatttacctcagaaagggaaatcgtctggaactccaggaagctcgacgattgttgttgagcctgatcggtctagaatgcatccgaccgagccagccctgtggggatagggcctacacgaactataacaggtaacttccatgactattcgccaggtcgatcctccacaccatctacaaattggcggtcgcttcgactttagttttcgttcgtccaggacggcgcgtctgtcgcaggaaaggcagcgcgccttaaccgacgtaaccatgggtatagtcgatcattcggatgagttcatcatcctctgattctctcgacttcagaccgcccaaagagtccgactggccgtagcatttcgcatcgatatccatcgaagacaggaatcctgccgatactgcggagatatcaactttgtcgccggccttcttgaaaccttcgcactcagcatcaagggccacaatcgcactcgcggccatgttcgcatgacttatgaggtcggggaagatcacaggaacttcacgcgacatgccacggaccgtcatcttcaggactacatacttcatactcactatcccttttgtatgtgaggaaagaatttgctgttttcaggatggtggaagcgctcggccgcaggcggtctttcttccggacattgaatcgtcgaaggcgggaaaaccgcgccggcgataatcgccgcgaggagtgcagcggatgtcgacatccagagggcggtttccaggctcacccgaacttccggacggcgcggcttcattcgctccaccctcttcccggttcataggatggtagactgccgccgcgaacccagttgtcccacatatggttcagaccagtcggtggctggggcggcgaactgtagaatccgggagtctcagtgctgctcaggaaataaggagtgcaaacggcctggacggccagttggtgccgctcccacatcttatcaatcgctcttagcatgacgtcttcgcactgagccttactgtcgaaccgtctgctagtatggtccggtatctggacacatccgtctccagtgcaaaggaaagcagtagcaatccatacggtgatactcgccatttcgtcaccctctttagttgatgagcagagtctattccatctgctcgccaggagtaaagcgcttttcgtcgggataaatgccgatgatgtctgcgtcgagcatccaaatgtccacggacggatcgtcgctgctgatttgatataggttgtacagctcccgtccgccgacagcacgctcgcctcgcggctcaaccgccagaaccttgccatgtccttctccgtgctcgtccaggtatatgacgtgatcaccgacttcatagctttcttttgtaacgaggcgtgaacgcgagctgttctgcgattccactacccaggaatccagcacgccgcctttcatgtcgcgaaacaatcttgccgatttgtcgcaatcgaatacgcccagaacttcgccgtctttcaacacgatatgtacgattggcaaaagagtattcatgtttaatctccattggttgataattagagtctaatctgccgaaaagttcccgtaaagaattattttctcataactgattagttgcaactgttaacctgatgtatatgtttgaatctcttttgaacgtttgatgtttcccctataataagcgcacacagccaacaaccacgtggaactacaatgtttaaactttcctggatattcgggcgcaaaaaggataatgctgcctgttctgaatcggcgccggagaaagtcgcacaaatccctcagcacgatccgctcgaccccatgatcaagctgggaaggattcgcggctggaacgtcgagccggagaaagccccggtaattcgtagcgtgaaagatttcctggagccgggcctatctgtagcaatggatagtgcgtatggtgatggaccaactccggcagcgaaggctgctgcgggcggccagaatccctatgtagtcccgactatgttgcaggactggtacaactcccaagggttcatcggataccaagcttgcgcaatcatttcccaacactggttggtggacaaagcttgttccatgtctggggaagacgcagcacggaacggatgggaactcaaatcggacggcaggaagctatccgatgaacaaagcgcgctgatcgcccggcgcgacatggagtttcgcgtcaaagacaaccttgtcgaactcaacagattcaagaacgttttcggcgttcgcatcgcgctgttcgttgtggagtctgacgatccggactattacgagaaaccgttcaacccggatggaatcacacccggctcctacaagggaatctcccagatcgatccatattgggcgatgccgcagctcactgccgactcgacggccgatccgtcttccgaacatttctatgagccggacttctggatcatcagcggtaagaaatatcaccgaagtcacctagtagtcgttcgcggaccgcagccgccagatatcctgaagcctacatacatcttcggcggcatcccgctcacccagagaatctatgagcgcgtgtatgcagcggaacggacggcgaacgaagccccgctgcttgccatgtcgaagcgaaccagcaccattcacgttgacgtggaaaaggccatcgcgaatgaggacgctttcaatgctcgcctggcgttctggatcgccaaccgtgataaccacggcgtgaaagttctgggaattgacgaaggcatggagcagttcgacacgaacctggccgacttcgacagcatcattatgaaccaatatcagctggtcgcggccatcgccaagactccagccacgaagctcctcggcacttctccaaaaggattcaacgccactggtgagcacgaaacgatttcttatcatgaagaactggagtccattcaagagcacatattcgacccacttctcgaacgtcactatttgcttctggcgaagtcggaagaaatcgatgtgcagctggaaatcgtctggaatcctgtagactccacgtccagccagcaacaagccgaattgaacaacaagaaagccgctaccgacgaaatctacatcaactctggcgttgtgtctccggatgaagttcgcgagcgtctgcgcgacgatccgcgttccggctacaaccgactcaccgacgatcaggcagaaaccgaaccgggcatgtctccggaaaacctggccgaattcgagaaggccggtgcacagtcggtcaaggcgaaaggcgaagccgagcgagccgaagcccaggcgggagccgtagagggcgcaggcggcccggttcccgccgctccacgcgcgactaagcctctcgcgaaggcggccgaggaaggggccagcgaggccgctgaaccgccgtcgcggccggaccccaaggccgagctgcggaacttgttggtcgatcttttgtcgaagctccaagacctggacgacattaaggcgccggacggcgtagacatagagcacaatgatgcgcctggcttaaagcgcacgtccaaacctggcgtgtctggcatggagccttcagtgttttcgtccaaccgcatcgtcgggcctcgtgatcattcggaactccagagaatcaaggtgaatggaataaccaccttgatcgaaaatccgcgcggaagcattcggcaaggaaaggatgggagttggcgagttcagatgaaacaccactatgggttcatcaagggaacgaaaggcgctgatggggatgaagtcgattgcttcgtcggtccgaatctgggatccaaacgggtcttcgtcgtcaaccaggtgaacaaggaaggtcagtttgacgagcacaagtgcatgctcggcttcaacaacatcaacgatgcgaagtctggatatctgtcatgcttccgcccaggttgggatggtctcggctccatccatgaagttgacctacccgctttccgtcgctggctggcgaacggcgacacaaccaaaccgtttggaggcgagtgatggcattcaaggcctccaaaaagcgcgaacgccgggcacctcttccggtcggaagagggaagcccataattccatcggcaggaatcgaggcctggtatcgaaagcagatgaaggatatttccaagctcatgatcgccgactatcgaagcgagattgagaaggcactgtcccagcctgcggccgaacggttcttcgccagcgacgaatccgttaacgtcctgttcaagatgacccttcgaagcctacagcagcgatggagccgcatttttgaaggtttcgcggccaagatcgccccggagttcgtcaaccggaccgaagaagccgccactgccgcgacccttcacagcttgtcggtggccggcgtcgatcagccacgagctgcgtataatgagagcgtcaggaacaccctggaggccgcaaccaattacaatcatactctcatcaccaagatccaagaggaagtccacgagaagatttacacatcagtaatgctgtctctgacttccccgaatccggaagagcaaggaacttccggcataactaacgcacttcgcaaagtcgggaagttttctgaagatcgaatcgaactcatcgcaagagatcaaacaagcaagctttacagttctctgagcgatgagagaatggcggaaaatggagtcgaggagttcgagtggctacactcttctgccggcaagactcctcgccacacccacctggagaaagatgggaagagattcaagctgaatgaccccagactttgggagggtccgaaagcagaccaggggccgccaggatgggcgattaactgtagatgcagaaagataccagtcatttgacatcgataggagcgctatatgccgttagttcatggcacttccaatgaggctcgttctgaaaacatcaagcgggaaatcgaagccggtaaggacccaaagcaggctgcggccatcgcttactccatccagcgcagtgagaaagggaagacggcgaaagattgttcgcctgagctcgtcgccgatcttcgcgccctggtggactctctgtcgaggctcgtgaaatgaaccgcaagacgtgccggcgccgactcgtggtcgatgtaatcagggccaatattcacggcggattcttcagcctgaagtttgccgccatcgatttggcaatcatcggcgtcgccatcttgatggcttttggccgataatgctgagaaaatctggattctgactaaaaattctagtccggatagccgcaagttaccgtttacggaaaatagcagtaatttggaaagcctactgccgcgaggctttaacagagccagttcctaatttccgatttagccgcatgcttcaaaagtatatagcctgtgaaattagaagtaacgttacaatagaattcatctataagtaacgttataatataacgtcaatctatatgctctagacgtattgaaattcaatttttaatcggtaaattggtaatttgaattagtttagaagttgaaagtctcgcggcagtaggcttagacaaatcccgtcaagtttccgagaccaaattaccggattttcgcggctgaggaaactggtaattagatcataatacaaattataatgtaagttaacagtcgcggctacatctaattattgttccgcttatttacccttggatgtactgcgtatataatacagccatagtccacgactcttcgaattaacgatggcaaagtcgaaaagaaaaattgacgaaaatggatatatgaccatcgagggctgcccgatcagctcttatggcgttttccagtattctgctggtcaactcggtcttccgggcgatccgacgcggattgtcaacgtatatcgcccggagtctgccgtcagcgatccggagtacatcgaatctctgaagaatctcccgttgatcgacgagcatgagatgctgtcgggattcgacgacgatgacgacagtgtggcccccgaagacaaaggggtggagggcatcatcacatccaacgcttactacgaagccccatgggcacgcggcgatatccgcatctattcccgcaacatgcagaatcagctggaaaggggcaaagaagacctgtccctaggctatagttgccgctacactgagcaacccggcatctggaacggaacgccttatgaagtcgtccaggacaagatgcgcggcaaccacattgccctggtaaaagagggtcgtgtgccgggggccagagtattggatggtctgtgttttgaccatctcagttttgatttcagaccatccgatgagggtaatgaaatgagtctcaagaaagccaagcggaagccccctgtccagcgcgtagggcaagctgctgactcggcggtcgaagagttgcgcgccctgtggccgaagctatctgcgtctgtccagaagttcctgggcgaagaagagcaggagccggagcatcaggaaggcgcagctccggccgaaccgaccgacagcgagcacctgaccgagcatccgactctggaaggtgcccagaaggatgacgaagagcaggaagaggagccttccgttgtcgatccggccgtggccgccgtcgagccggagcatcaagaaagcgccgcatccgaaatgtccggtgaaggcgaagtcgccgaactgatctctcaggtcaaagccattctggctcgactggagggcacggtagccgaaggggcagacgaagagcatggcgaaggtcaagatgtcgtcgagggcttggaggagcagagcagcctcagcggctcgcaaaccgccagcgacgatggtggtgagagcaaggataacagcgaggaacttcctgaaatggcacagaagaacgcgcaagatgctgcaattcgcggtctctatcgcgacattgctgctaaagatcgcctctacaagcgtcttagctccgtggttggtgcgttcgatcaccgagctatggactcggctgaagtcgctgtttacggcgtgaaaaagctgaacatcagctgtgcgaagggccaggaagctctggcgctcgacatgtacctgaaaggcgtcgaagcctcgcgcggcgcggccagccgtcaatcgaaagcccaggattcggccggttctgctccgcagtgcgccgagctggacagctacctgaagggggagtaactcatgttccagaaacaagtttaccgccagtacactcctggttttccgggcgatctgatcgaggacggcccgaagcgggcgcggccgggtcgaatcatgcctctgtctgccgtaaatccggctgccaccgccaccggccccaaccgcatcagtcgcgctttcggttacgccggtgacgtcagcgccctcggcgaaggtcagccgaagaccatcgcggctcgcgcttctgaagtcgtgatcggcggcgccaacttctttggtgtcctcggtcatccgaagcactatgcgctgttcggttcggccggagactccctggctcccagctatgatctgcccgatggcgccgaaggcgagttcttcgacatggccaccggcctggtcgtcgaaattttcaacggcgccgcaaccgccctggacctggactatggtgacctggtcgcctatgtaccaaacaacctgcctaccgccgacaacgcgcttggcctgccggccggcgccctggttggcttcaaggctggctccatgccgaccggcttggtccagattcccaacgcacgcatcgttaacgccatcagtctgccggcccagtcggcggggaatctggttgctggcgttaccatcgtccagctcacgcagtaaggaggcgtcatgagccagatcagcaagacccattcgcgcctcgcaggccgcaatgcgaaacctttcgacctgaaaaacatcaccaatgacgccgtggcgtctctgcgccgcatcggcctggtattcgatcacgccgtcgtccaggaccagatcaaggccttggcgaaggccggcgcgttccgctccggctcggccatggacagcaacttcaccgccccggtgaccacgccgtccatcccgactcccatccagttcctgcagacctggctgccgggcttcgtgaaggtcatgaccgctgcacggaagatcgacgaaatcatcggcatcgataccgttggctcctgggaagatcaagaaatcgtccagggcatcgtggagccggccggcactgcggtggaatacggcgatcacaccaacatcccgctgaccagctggaacgccaacttcgaacgtcgcaccatcgttcgtggcgagctgggtatgatggtgggcaccctggaagagggtcgtgcctcggccatccggctgaacagcgccgaaaccaaacgccaacaggcggccatcggtctggaaatcttccgcaacgccatcggcttttatggctggcagagcggcctgggcaaccgcacctatggttttctgaacgatcccaacctgccgccgttccagaccccgccgagccagggctggtccactgccgactgggcaggcatcatcggcgatatccgcgaggccgttcgccagctgcgtattcagagtcaagatcagatcgatccgaaggcggaaaagatcaccctggccctggccaccagcaaggtggactacctgtcggtcaccacgccatacggcatttcggtttctgactggatcgaacagacctatccgaaaatgcggatcgtgtctgctccggaactgtcaggcgtccagatgaaagcccaagagccggaagatgctctggtgctcttcgtcgaagacgtgaacgcggccgtcgatggaagcaccgatggcggcagcgtgttcagccagctggtacagagcaagttcatcaccctgggtgtcgaaaagcgggcgaagtcgtatgtggaagacttctccaacggcaccgccggtgcgctgtgtaagcgtccgtgggccgtggtgcgctacctcggcatctaaccgatgcctattcaccaaaggccgggtttccggcctttgttcactctgactctgactcggttgtaggggccggttagggcataattactaggactacgccaatgactgtttacatcgtttccgccatgactcaatccgtgtcttacaatgcgtatgacacctctgatccgtccaatcctcgcctccagcgaaagattctgattcgtggccgcgccggcatcgcatccgaaacttccggcttcggcgacatgatttccgacgcggccgggcgtccgatctggaccccgcagggcgattgcactgccgtgagcgattcggatttcgagctgcttcaggccaataagattttcatgcgtcacatggataagggctatctgcgagtcgtgaagacagacatcaccagtgaccaccagcggattgccaaagagactcgcaccatggagcgcgatggattccagcctctggacgctgctcgtttgcagcagaaaatcaaggttaccaccgccagcgcttcccaggaacaagagttccggatttaaccgagggtttcggtatggtgattttcgacgaaaataagtttcgcacgctgtttccggagtttgctgatccagccgcttatccggacgtgcgcctgcagatgtatttcgacattgcgtgcgaattcatttctgatcgcgattcgccataccggattctcaacggcaaagccctggaagcatgcctgtatcttctgactgcccacctcctgtcgctgtccacgatgcaagttcagggcgcggctggaggtggcgtcacagcaggtgggactcaaggcggtttcatcaccagcgctactgtcggcgaggttagcgtggctaagctcgcgcccccggccaagaatggttggcagtggtggctgtccgggacgccttatggccaagagctgtgggcgctcctcagcgtcaaagcggtgggcggattctacatcggaggtcttccagagcgccgaggcttccggaaggttggaggaacgttctggtgatccctggtgcgaatcttctgcgaatggccttcggggtcatcggtactcaaattgtgaaatatcgcaagtttgagcagcgagtgaagaatgatcaagctcagtacgtttccatgttcgaggagcctttcgacctggcagcgtctgtccagcgagtccgacgcgatcagtatgtccagtttaatctggagttccaacggaattatgttatgatcttcgccaactttgagatggttgacttggatcgcgatgtggccggtgaccagttcctctggaccggaagagtttttcagctggagtctcaaggctcctggttttatcaagacggctggggagtttgcctggccgtggatatcggtgcggccaagctcactgatgacgggaaaccgactttctaggtgatgtatgtttgacggcgaactgatagcgaaaatggttgtcgagctgaatgcggcgatgacatctgctcaagaggctttgcagttcccggattttgaagtcgtccagaaagctcagccgacccaacagggaacgtcaaccaggccgaccatctttttccagaaactgtttgacattcctcgcggctggcctgccaccgattggcacctggacaacaaggctcgcaaatatgtagaaataactcgacagcatgtagagacgactttccagattagttcccttcattggcagaatcctgaaataactcacgtggttacggcttccgatatcgccaactatgtgagggcttatttccaagctcgatccacgattgagcgcgtaaaggaactggacttcctcattcttcgcgtgtctcaaatttccaacgaagcattcgagaacgataatcaccagttcgaattccacccaagttttgacatggttgtaacttacaaccaatatattcgcctgtacgaaaacgcagcatattcggccgatggggtattaataggcatatgagtctgaggcgcgattcagaactaatcgccgcgcacctccagatgttaagagccatgcgcggcaggtccgtttcggccggatggtattccacggctcgatatcctgacaaggcaggcggatcggtcggaatacaagtcgcgagaatcgcacgtctcaatgagtacggcggaactatcgaccatccgggcgggacaaggtatattagggacgccattgttcggggccggtttgttggcgttcggttcgtcagaaacgactttccgggagaaaccgaggtaactaagcctcacagaattaccatcccggctagaccgtttatgcgatatgcttggaacttgttttccgcagatcgcgccgcaatccagaaccggatagccatgaggctggccagaggacagatcactccagatcaagctcttgcccagatcggcctggcgttggaaggatacatagccagaagcatcaggaccgggccatgggtggctaactcagcatctacggtcaggagaaagggattcaacagaccgctggtcgatacggcgcacatgcttcaatcgattagcagcagagtaacataaccaggagatcatccagtgatcagtcagagccgttatatccggatcatttcgggcgtaggcgcaggcgctccggtcgcaggccgaaagctgattctgcgcgtcatgactaccaacaacgtcatcccgcccggaatcgtcatcgagttcgacaacgccaacgcagtcctgtcatacttcggcgcgcagtcggaagagtatcagcgggctgcggcttatttcaagttcatcagtaaaagcgtgaattcgccgtccagcatcagcttcgctcgctgggtaaacaccggcatcgcgccgatggttgttggtgacaatctgccgaagaccatcgccgatttcgccggcttctcagcaggggttctgaccatcatggtcggcgcggccgaacagaacatcaccgccatcgatacgtccgctgcgacttctatggacaacgtggcgtcgatcatccagaccgaaatccgcaagaacgccgacccgcagctggcccaggctaccgttacctggaatcagaacaccaaccagttcaccttggtcggcgccaccatcggcaccggcgtcctggctgtggcgaaatctgccgatccccaggacatgtccactgccctcggctggtccacctccaacgtcgtcaacgtcgccggccaggctgccgatcttcccgacgcggccgttgccaagagcaccaatgtcagcaacaacttcggttcgttcctgttcgccggtgcgccgctcgacaatgaccagatcaaggccgtgtcggcctggaacgcggctcagaacaaccagttcatctacacggtcgcaacttccctggcgaacctcggcactcttttcaccttggtgaatggcaacgccgggaccgccctgaacgtgctgtcggcgactgctgccaacgacttcgtggagcagtgccccagcgagattctggccgccaccaactacgatgagccgggcgcttcgcaaaactacatgtactaccaattccctggccgcaacatcaccgtttccgacgataccgttgcgaacaccgtcgacaagagccggggcaactacatcggcgtcacccaggccaatggccagcaactcgcgttctaccagcgcggcattctgtgcggcggtccgaccgatgcggtggacatgaacgtctatgccaacgaaatctggctgaagtcggctatcgctcaagcgctcctggacctgttcctgaacgtcaatgcggttccggcgagcagcactggcgaggcgatgaccctggcggtgctgcagccggttctggacaaggcgacagccaacggcacgttcacctacggcaaggaaatcagcgccgtccagcagcagtacatcacccaagtcaccggtgatcgccgcgcctggcgtcaagtccaaaccctgggttactggatcaacatcaccttctccagctataccaacagcaacacaggcttgaccgagtggaaggccaattacacgctgatctattcgaagggcgatgccatccgcttcgtcgaaggatcggatgtgatgatctaatggtttgcggcggactcgatccgccgcgaccttccataaatggagtgaggaataaacaatgatcaacatttctgcgttcggctcgatctgccagttcacggcaagtagaactttcccgaacggattcaccgtcaccgagtttgccgacgatgcggaccccatcgacagcccgccgttcactgcggccgataccggcgtcggcctcaacggtgacatggtagtctggaaccgggcgaacatcctggaagtcgtcgtcaacgttatcccgaacaccgagggcgagcgcaacctggcagtccttctggatgccaaccgcaccggaaaggacaagtcgggcgctcgtgatgtcgtcggtttggtcgtggcgatgccggacggcagcaaaatcacctgcaccaacggcaccccaatcgacggcgttctgatcaacgcggtggcaagcgtcggccgtctgaagaccaagccgtatcggttccgatttgaaaaagtgatcaaagccggtactagctgatgaagaaaattccgctgacagcagtccccaatcaagcgatctcatttaacgccggtagcagctattggaagattcgcctgtaccagaacatggacatgatgaatgccgatatcagccgcgacggcgtgatcgtttgccatggggtccgctgcttcggcgggattcctcttctccagtacagccatcagtaccgacctgactatggcaatttcgtcttcgaccgcgacgccgattggacattgttcggcgacggcatcaacctgttctatctggacggcgccgaattcgccgagtatcaggcgcttgccacgaggaaagaatgagcacatcaacgatcagaaccgggacgaacaacgatatccttttggacgacaatggaaacatggttatcctcagggatgtcgaagcgtgcgcccaggacgttcgggcggcgatgctcatgcgcaccggcgaaaacattttcgatgtgaactccggcgtgggatatttcgaatacatcttctcgccgcagaaaagctatgatgacgctcgcaaatccatcgcggacgcaattttatcctcaccggatgtgaccggcatcgagcagcttgacatcgacataaccggggaagtcttcggcgtcgatgcgaaagtcatcaccatccacgggcctgttaccacaggagtttgaaatgagtaccatccgcatccaatacgccaacggcacccaactgttcctggacggcaaaaatccgccgcccctggacccgctaccctcgtttaacccgtctgtcgaagatctggaaggcctggaccgcgaaaagaacaccgacaagggcgactcctctccggccggtcttcccgttcccccggtaaacgtcgattcagatgtcgacaacggcggaaccatcccggctccggtatcgaccgacgctgctgcggccgaatcggccccggaaggcgcccaggaagctcctgcagcaggccaaggcgacgagaaaggcgccgaggaagccccgactacagccccggtagaaaaggccgaggaaacggcctcgccggccgctgaagaggaaaccccggctcccgccaatgccacctctcgcaaaaccaccagcaagtaaggactcgacatgatcaacgtcagcggcttcggcaccggaattgtaatagtttccgcctcatcgttcccgatggggttttccttgtcgaagttcgctgatgatgagagtccgatatcctccaaagagctggagccgttcggatatgagatgctttatgacggtggcctattcgcctttgacaaggctgctcctctggaagtatctgtatccgtcatcgcagggagcgaggatgatattaaccttcgcatccttctcaattccaaaaagggatcattcagatttcttccgggaatcatcccggacatgacgactctcgtggccactcttcctgatggcggccgcaccgttctgtccaatgggactatcatcaagggtccggccatcgacaccatacagaacaccggacgacgcaaaggcaacacgtacacttttgttttcggtagctatcttggcgcccagactgctcgtcaagccatttctaacgttatccaatcggtactggaggtggtctgatgttagggattttcaccagcctcctaagttcgcgatctttttcgattgtggaccaaaacacaaaccagctagttgctgcggatttgaggataagccgggtcaacacccggttttcttctgtagggcaacgccacatgctggaagatggtacgaccaagatggattccagaacgatccaccctatggaaatcatcgtcgaagtattttgcccttcaattgatgtcgtcgatcagatcaatcaattgctcctggatcgcgacacactgtacaaagtcatcactcgcggcatggtattcgaacggatgatgtgtaccagcgaagcgctcaatcagactccggatatgatatcggcgactcctgcgcggctgacattctcccaagttctcgtccagaatcccaagcctataatgttcagaaatgcaggggactcttctatgatcgaccgagggctggccctagctgaagacgtggttggctcggccggcgatctgttcgactacgcagtgaacggcgtccagaacgccgcagacttgttctgaggtgccaattgaactctttcctcaagtctattctcaacacgcctactctcaccatacgcgatgatgtcaccaaacttcctgtctggaagagtcttcaagtcaagaaagtggaaatttactcgccggcttccgtagtgtcgaaacctctggcgacgaaagaccagacggaagctcaagtgtacaccgaagctctggacattgatgtgaagaatggaaagatcatccaaccggtgcgactccgcatcaatgctatctgtccggacctgtccaccgttgaaagtatcatgaacgctttcaatgataacacctcgactttcgctatcacttctaagtcgatattggccgataaaatggccatcatgacgctcgatgtagatcagtcgccagacatgttgaacgcggctgagatcaatatggaattcgagcaggttgagcctccagtattgaatgaattcgatcctgcgttccctcaagatagtccgacttatggggtacagattcaatctctttctgatgctaatttgctggatttgggcgccatcggcgattcgatatcttcggccgcaaaatcgctatataatcgcgtgaccagctacttctgaggatgtatcatgcttgaaatcaatcttcccgatggccgtcaaactcgcgtacaaatcgaggcgtggtcggcattggatggctgggaactccagcgccgtttcgtcgaattcgctgtcagccaagattccgacttccgccgctctttcaccatggaaatcctgggctatgcgaaagtgctgcttggcgacgacgacaccggtattccgctgaccactgcggcggtcatcaacaaccacctcggccactggaagaacgtggaactggttttcaactctgttctcaagcacaatggcatcgacccggccacgcacgccgaccggccggactattgggaacaagtcggatcgcagatggccatcgcatttctggccgaggcgtccaagctcattggtccagcaatgaagatcgccgaaggactcgccaacaagccggagtgattcatgtctagtgatttggatgaattcatacttcggtatgaggccgatactgccagagccgagcgcaatctggagcgcctccagaaccagatcaggcgcgtgaacagcgcatcgacgagtggccttcaggatttgcgccacttcgcagacggcgcggccactgaactcggccgagtcgttccgcagatcgattctgtgacgagcgcgattcgcgggatgaacgcgcaactggcgataggcgccactggcgtggccctggtcgcggccggcgtcaaggcgttcatgaacaccagggaccagtacaaccagcaacgcatccaggcgatggatatcggcatcgccccggcgcgactggaagagtaccagcggaagtttgctcgccagtctggaggcacgatcagccgcgagcagggcgcggaaatgacaaaaaatctggccgacactttccggcgagcttatcgcgatatcggacgggtcggcccggaagcgcgaattctgcgtatggccggcgttgatgtcgggagcttccaaaagggcatgcggccgctcaacgacatcattactgatctggccacgaaaatggccaagctgaagccggacgaaatttctgcctacgctgatgcccttggcgtctcgcgagactacctgagcaccctggctaagatcggcccagccatgggaaaagtcaccgagatgacgactgcggaactccagtccagggtccagggcgagtccaacattcagaaattcaacgatgctctggcgaatctcaaccagacgttcaccaccctggaaaaccgagtcggcgaaaagctcgcgcctgcgttcaccaagctgatcgaaatcatcgacaagatagtccaggctattcccaatgaagtggaagaattcgccaaggacaccaaagcccgctgggatgacggcatcaccggaaaggctacggttggtggtgatatcctttcccttctcagccctggcgccctgctaggccgcctggcctcctggggaactcggcgtgggatggaagaggcaggcctgatcgacaagtcgaaggttcccggcgctcaaaccagcgaagacctggccaagaaacaagaagaccaggacaaggctactaagtccatgaaagagctagagaagctggctgaccagaccacgaagtctaccaatgattttgcggtggcgatcaacatgttcagtggcgcggtatcgtcgttcgcgaatgccgttgacgagcgccaagcttgggcagcctgggcgggggaaattggtcgggcggtcggtatgggaagcaccgcgccgacttcgcgggccaccggcgtctatccgcacgcgatctatgatcagtcgaagagtggcgcggccggacaggtcttcggcgagccaatcggcgcccagtctcttcgcaatcgcatgttctcgccgcagcgcaaggccgaaccggtcaccgttccatcgtacatcaacgatatcatcaaagatgcttcgaagatgtacaacattcctgagctggacatcaagaaactcatatacaccgaaagccgattcaacgccagggccaccagcgaagccggagctaaaggcctcatgcagctgatgccggaaatcgccaaggcgtatggtatcactgacgtatatgaccctcgccagaacatcctcggcggaacgcgcctactgcgggaaaacctagatcgagcaaatggcgacatgcggttggccttgacctactatcatggcggactcgatccgaagaactggggcccaaggactcgcgcatatccgggtttggtaatgagcgctccaatcgagctgatggaagaggctcagcgcaagcagaaggctgcggccatgaccgtcgccaacgagacgttcgccccggaaggcggcgacatggacattcgtccctatgatggcgggcgactggaaaccccagaccagggcaagaaggaagatgagcgccgcgaagcccgtcgatatgacgacagggttgtgcgaccggaaattcgcatcatcgaccgcatgccagaccgcagcgacggcgaaatcctcaagatgtctagacgtcaagaggccgaccgggcagattctggattccggaagttcccgaatcaagttcgcggcgagaccaagcagaacatccaggctcaactcactgcaggagccatcgcgcaagtgatcggcgttaaccccaaccagatcatgcgccgcgaaatcagccgttctgacttgctgttcggatacaaccaagccatcctgggcaagcaacaggagatcaaggccgccgcgaccgaagccaacaacgtattcctgtctccagccaagcttgccgaagccacggccaaggtgaacgccgcatcgcgagaaatggatattctcaggacgtacggcgagcaacttctgaagagcgctccagagcgcggccaggagctgaccatcggtcggatcgacatgttggtcaacgtcaccggcgcgaattctccggaagaggctcgtgagatattcagcaagcagactgcagaccagctgactacggcaatccaggacgctcaaaacgattccgcaactaagatactctactgatgaaaaagagaattctgcgagtaacattcaacatgccttatggacccgaagtcatccgcgaagatctggatgttcgggtccggattatgaaggctgcgttgcggattcagaaccgggcgacgatggaaattttcggcctcaccactcagctgcgcgagtctcttctgtcgcagttcaccgcgtggaagcaccggcaacgtcaagtgggcagggaagatgaattgatgatcaaggtgtcggtggaagccggctactctgaccaggggcgcgagcaagtttccagagtctttgtcggcgaagttgccattgtcgatatcatttctccgccacctgacattggaatccgcatccagtgctataccaggcaaatcgacaggacgaagaccattcggaatatgccgcccgccaacacgacgtttgtcaagttcgtcgagtggggcgcgaacgaaatgggattgaacttcatctgcgataccagttacaacgatcaagttctgaagaatccgggccggtctatcactgtcgcgtcggcaatcctggcgtcgattcaggatatgtacatgccggacgtggccgcgttcgtcgatgatgacatattgatcgtgaaggaccgcgataaagtcattcgtccggatgaggtgaccaacgtcaactcgtttgttggaattccatcttggtctgaatggggcgtggaattccagtgtctgtttgagccatcgattcgtgtggctggaggcgtagcggtcgaatctctcatgaatccaagtgttaatggtaactatgtaataactgctctggaatacgagttggccagtcgggatcggccgttctatatcaaagtcatggggagtccagcagcataatggccagggaaatcaaatcattcaacatgttcggagttcactatacttcgcggcaattctctgctgtcgatgggctcagcatgatgtcggaaattcagaacgtgccgccagaagaattgctcaagggtactgatgtattggcgcatccggaagaccatccggaaggcatctggcttccattgactgctgcgaacatcaatctttatgtcgttgatcgagcgaaagtaatagctcccgtacaagttcttgcacttctgtccgaagtggtaatcgactggaactttggttttctcaaagactggaccggagtcaagattccatccagatttgtcgaagatatcaaaagcgtgaagacggcacattcaccttctgtagttgcgagcttggtcgcgaacggctcagcctctatgcgcgagttggaagagtattattcgactcaagatgcgtttaagatgatagacatcatgacggcgaagagcgtgaacgaggccttggcgtccgaagcatcgcacaacagaatcaaaaagggataattcctaaccgggcctgggaaggctatactagacctgccaaatcagaggctttcccatgtccaatatttctctaacatccgcaaaagctcccgacaggacgcgactgatcgccgctcttgacgctcggtcgcggcgggatgctctagatttcgaagtaatgataccggctcaggttgttcaatatgacagggccgagaatatcgcgacgattcaacctctcatcacctgggttgacacggaacacaacgccgtccaaaggcatcagctggttgatattcctgtaatttccatgggggctggcggcttccacataagtttcccgattcagcaaggtgacataggctggatttatgcggccgaccgcgacacgtctcagttcctggagtcgttgtcaatgtcgaagccgaacaccggccgcatccataagttcgagcatggcctgttcatcccggacgtattccgtcgatacaccatcaattccgaagattcggccgctatggtcatacaatcgacttccggagcgaccagaatttcgattcgcggcgacaacatcaagatcactgcgccgtcgaatgtcaccgtggatactccgcaggcgaatttcactggtgatgtgactatcgctaacactctggttgtaaacggtatcaacgtgaacaaccacggccacctcgaaaacaacccgcctgatgcccggacgaagggcggcatgattgcttaaggagaatttcatggcaagttttgatttttctgatttaacagcgggggggtgtaatggctaactacaactacatcgtcgatactggtgtgatagtcgcagataccgccgacgttctgagtgacgttgaagccgagttccgcgccgccctcggtgccaatatcaacttggccgcgagcactccgcagggatcgcttgtcgcggccgaggccatcgcccgttccagtgtcatgcggaatgaagcgcgaattgccaataccataaacccgaacgtttcattcggaacgttcctggacgcgatctgtgccttgatggggatcgagcgcggttctgacctgtcaaccttcggctatggagttcaagtcaccggccgcagccaaacccgcatttccaacgggtctagggtccagactccggccggcgcgatcttcacagtgatgagtgatgtcacgattcctgctggtggtgtcgcgaccatcgatatcaaatcgcaggagtatggcaacattcctctgccggtcgggaatctcatcatcatcgacggaacaattggctggtccggagcgaaagtcatcgcctccactcgcgtcgatccgggcagccgccaaatgagcgatgcagagttgaagaatgcccgcgttaatcgattggccatccaaggccgcaactcgactatggccatcaaggcgtatgtgagcgccgttccaaacgtcacgtcggtgaacgtaatcgagaacaacaccggcgccgttcaagtggtgaatggagtctcgtttacccttccgtatgctgtttgggtctgcgtcgccggaaacccggataaacaagcagtcgccgatgcgttgtgggccgcccataacggcggaactccatgggactatggtgcgacgaacaacggcgtcccggtggacggtccgaatggcgttcctgtgcgcgatccggcgtccggtcgaaagtatgtcgtgaagtggaccactccaattatgtacgatggatatgttaacgtaacagtccagcaaggttcctcctctgtagctccggaagccattcagaacgcagtggtcaattacgcccaggggaaagtggaaggggaagaggggctggtggtgggcgcgagcctgtcggcattcgaagtcgccggcgccatcgctcgcgaaattcccggcatctacatcaaactctgccaggtcgcgtgcgtcgcggctggctcgccggctccggctccgggcgatttcacttcggaatacgtcatgagcgcattcggccaggctaccatttccgttggtaacgttcgggtgactttcgtatgactctgcctgcgtacaattcggacatccaacaagctctgaaatggctccataaccaggcgcctggaatcaccggcctgatccagagaaaggcgcaatggtatgacagattcagccgccaattctgggccaactgggagcgcgacgttttccacttgaaaactgccaacccgttcggcctcatggtgtggtgcatcatcctcggcacgccgtcgaaaggattcggcctatatccaaaaaacagttcttgggcattcggtcggctacgccagaacttcatctatagcggtacacaagttccgccaccggcagacgcatcgccgggcggcaacttctacggtggcggcaatgccgaaattctcaacttggacgaaatcaggaaagtgcttcagctaagatatgtagcgctgatttcgaacggctcgattgcatatatcaatcgcatgcttcgctacatattcaatgatgatgagccgtgggacgaggcgaccggtctgtacttctatctcatggactcaaccggcgaggatggccctgtggagaacttggccatatatcggaaagattgggaaggtatggtgctgttgtacagttcgcccagaacgaaccatgtgctgacatcgacccctgccagcgacgccgattggccgggagtcgatccggccgcgagcggccgtccggtaacggtcgaaacggcgtccgctacggccccggacggctccgctacggtgtgcaagcttactaagccggccgggagtaccgcttacgtctccgcgccgatagatgggccgctggggtccggtagcactgtaacgttctcgttcttcgcgaaagccggctccacccgtttcattgcaattcagtcggctgccgatttccccagtcgagccgatgccgttttcgacctggattccgggcacgtgatcagcgatcagatgttggacagcagcgtggtaagcgcccgaatgattcgtctggagaatggctggtggcgttgcgttctcacgaccaagaccgtcagctcttcgttccgcgctgcttacgtcgcgccggcagaaaccaacttcagctggattgattctaattcaagtatggcgattgacgtgcttatctggggcgctcagatcgaactgggtgatactccaaccggatacttggagactaccggggcgcccgtaaccatcaccgattatgtcttgcagaatgcccagaccggaacggtcgagttcacccagccccttccgattggagtagaagcgtattggactggcgactggaaaggcgggtctgcgaccgagccggccagattcgcggtaggggatgggactcaagatacattcaatctgtccagtcctgcatacataggcctacccactagtggggcattcaagttagaatacagagttggtccggcgcttaatttgtcgccgcaattgatcaacctcatgaatgaccgggcggtcggtatcatgccgacttgcgccggttgcgatgtaaaagtcattcaggagtaatgacgtgatcacacccgaactgatacccagtccgtttgctgcgcagggcgacaaagacccgatcccgcagacctcttccactggctttgccaaccttcgcgatggctacacgccggactacgaaatcagtctggagtcgaacaacccgcaggccaaagcggtcgagcggaaaattcaaaaccaactcttcttcatcgcgacccagaacgcacaggcgtggcagcggcaaatggcgccgccgtggtttcagggcatgccgggcggctacgaacagaatgcagaagtcgtgcgcgtcggaaatgacggcataatgcgtcgctatcgttccatggtgaatgccaatgcgagcgaccctcttagcagcacgacttgggaagaacaacccgcctggtcggtgatgcgctccagcatcccgatgccggctggaggcccaggcctatcttctggcggagaagtcatcacgactggccgcaacttcaacgatttgttgaatgggacgtgggagttcttctctgattcagtggttatcgcttctcagaatgcccccgtatatccggcgtccgctggtgccgctgctggcatgttggaggcgaaatcttggatatccgggtccaatacgttctgcgttcaacgctacactgaccgcgtcgggaacgtcgctgtgcgcgggcttaatgccggggcatggaccaactggatgtatgctgtaaacgtcatggccctccaacaaggtcgagtgacctatggagtcgcggccggcccggcgaacgcttacacgttgacgctcgttccgcagctccaaggcggcctggtggacggcatgatccttcgggtcaagttcaacaccgtgaacaccggcgcctctaccatcaacgtctccggactcggcgccaaagccatcgtcggcgcggccaacttccctctcactggcggcgaacttggccaaggactcatcgctgagcttgtcttcgacgcagcaggcgaccgctggaggattctggcaggcgcgccgcgcatccaagtgggcaacgcagatcaggactaccaggcccccagctggaaacaggtgaaggactatgtagcgtcccaaaagctcaccgaagtggattgggccgatgtcgtcaacaagccgaacgtcgccatccaagacaccacgccgtggttcgccaatctggagctgtctgacgctcggcctttcatcgattttcatttcaacaacaaccgcgccaaagacttcgactatcgctttatctctgaggctgatgggtcgatggcattctattctcgccaggggtctgccggtcctacccaggacatcctgttcagcaggtcgaatgtaacattcctccagccgcgactggatgttgcgaaaaacctcgcatacatcgcgaactctggtcctctttggcagaacaccactgccgatcagcctggttggaaattcaccttcgcacaaggcgtggacgccaacaacaacgcggtgatagcagtcaataccaccaatcctgacggctcttatcgctcgcaaatcatgcgatgggactgggcgtccacgaacgtcatattcaacaatcgccctctgtttgctggacaatacgttccttgggactccggaaactttgatccagccaccaagctcactgtcgggactaccaacaacatttcgggaccgaccggaattcgcaataccaccagcaataccggaaatatgaacacctggggctccagctccacaactgcatcgtatggaaacgcagctcttcaaatcttcggcagagggggtggcgagcctgcggccatctacttcgacaactcccaaaccggctggtatttgggtatggacaaggacggccagctgaagcgagcaggctggtcgctcggcaataactcctatgtggtcaccgacgagtcgaatattcgtttccacgtgaattccatggctggcactccggtatggggcggaaatgaattctgggggccgtggaacttcaacccgaacaccaagctgaccattaaagccggcacgcaggaaactagcagcactgcgatattcagcggaacgatgccgttcgccccaatcgcgtctctgtcagactattcccaggcgccgttgacggtttacaactcgccgactggtccatctgctaagcctgccgtcatcgcgttcattcgccctggcaactggggagcgttcttcggcatcgataccgacaacaagctgaaatggggcggcggatcgctcggcaacagctccagggagatcgccgattccagcaacatcatgaatctttgggcggccaacccgaccgcgccgtcctggaacggccaaaccgtttggcgatccgggaactttgatccggcaacgaaggtggatttgaacgccgcgaacgccaccaacggcaacatgatcttcaaccgcatcgccggaactggcagcgggatcgcctcttcaggccgcgtcggcgcaatcagcctccagaacggcgcaacggcaggcgcggccgcagccgtaacattcgagcggggcggtggtttcttcgtcaacttcggtttggacaccgacaacgttctcaaagtgggcggcggaaacctgggggcgaacgcctatcccatcatccactccggcaactacaacaactacatcaaccaggcgctggttcaggtgggtcttggcggagtcggttcctatggcatctttgcggttctggacattgccgctccaaccgcgaccgttcaaccgggagtggttgtggacggttccattctcatctactcgtcttgcgccgcaaactacaatagcggtcaaaggcctgccggaacttggcgctgcatgggatatgtagtcaaccgggatgccaacactcctgactccgcgacccttttccagcgagtgacgtaaaatgaaatggacgcggatcagaaaccctcgttggctggatgaaacaaacatccacgccatggtgactttcgaggggatcggggaagttcctttcaccgccaatccgcacgacgtggaggcccacggaagggccatccacgctgcgatcctatccggggcgcacggacctatcgccccggtcgatgcgaagcgggagcaggccttgcagggcgctatacgggccagggaaaagcgggctatccttcgtgatacccgctggcccatagatcgtcacgacgagcagaggcggctgggtatcgaacccacggatggacctgggctgatcgcagcccttgtttactggaggcagcagattcgcgattggaatagcggggatcggccgcgacttcccatggctttgaaaacaatgttcaaaaatcaggagtactgatgaaaataacgaaggatattttgatcacaggaaccggatgcaccacggatcgggcgatcaagtggctggatgacgtccaggcggccatggacaagttccacatcgagtcaccgcgagccatcgcggcctacctcgccaacatcggcgtcgagtccggcggactggtaagtctggtggagaatctcaactacagcgctcaaggattggccaacacctggcctcgccggtacgcagtagacccgcgagtccgcccgtatgtcccgaacgctctggcgaaccgcctggcccgtaacccggtcgccatcgccaacaacgtgtacgcggatcgcatgggtaatggatgcgagcaggatggcgatggttggaagtatcgcgggcgcggcttgatccagctgaccgggaagtcgaactattccctgttcgccgaagactccggcatggacgttctggagaaaccggagcttctggaaactccggccggcgcgtcgatgtcttctgcctggttcttctggcgcaatcgctgtatccccatggcggagtccaacaacttctccctggtcgtgaaaaccatcaacggcgccgcgcctaacgatgcgaaccacggccagctccggatcaaccgctatatgaagaccatcgccgcgatcaatcaaggctcctgacattccacccaaagaaaaggccgcttattcagcggcctttttgctttctggctttgcctcttcagccatcttgacctcgaccggcgcggcggactcctcctgagttaccgaatccacatagttccctagtgaactcagaacgccgattaacagcgctcttactaccttgtccttgactgtctcgcctatgatcttggtcagaacggatatcaactcttcccggagtcttgggctgattcttggccgaaagcgcttgcgatgctctttgcgtttcatgtttagtcctctgtctgcggtcttctcctcaccccgataatggcttggggatgcgctgtgttagtcggaagggtcgggcgctattataacccgtcgaaaatgctcgcgcttaactgtttaacgatacgcaccgcgatactaaatcgccttctttctggccaaggaactctggcggcctggtccggtctaaggcctaatttgtcgacattaaaacgagaaaacccggatcgcctgtaggacaaggcgtccgggtttatttcgatctagtgtacgctagaatcagtggcttccgccccaaccgtccagccagcaatcgaagacggcgtgtctcggcttgtccttggcgccatgggagaagtgcttgaaccggatgacctggcccttgagatactccctgtcattccagcggcgctgtttctcgtcgtgggtcaggctggaggccgacacgttgaaggtgactccaggccacagacgttcgttgcggcagacgaacgcaccgaccattccggacggcgacaggttttctgcgtggctggagcgggccgtgtggccaagttcattgatgaaagcttcattgttgttgtgcatcaactcttccacgtcgatgatctcagcttcatcgtagtcgtatcgcttgactttcacacagtgcccttccttggcagtcgagcgaccgaacttgtacagtccatcagcgcgcttgcccatggacccttcgaatcccagcatcgtgtggcggcgctcgacttcgctgaactgttcgatggaagtcaccagttcctgctcgaccaggtgaatcctctcatagccgaggcagttacgcaggaagttcacgcgctcggtcgccctggctaggcgctcttcggtcggtgcacgatgatcggtgaaatcatcgaacacatggaaagaccagtccggctcaccgctgtggcggcgaagatcgccggacgacttctggaaaactttcgggtcgctgatgtcgccgcagaccagctcgccgtccaggccgttgaacagtttatcgctgaggtattcgtagatcgattgattgttctgccgcttgagttgacgagtcagcgcctcgccttcgaatacgaagcagcgaaatccatcgatcttcggcgagaaatacatcggcagttggccttccagcagcttcgggtcaaaattcgatgcgagcatgggtttcatacagttctccagaaaagaagcccggcgaaccgggctaaatggcggtaagccggctcagatggtttcgttggcgtggttcagttcggccatgatcgacgcatagagctcatccgactccttgatgaacacgccgtcgtacatgacgcctttgcgatccttgatggtgtcgtaggcagcagcgtagcaggcgagcatggtggtgtcatgctcttccgtcacgtcgaacagagtcatggcggccgataccaggctcttgatggccaacccatgatttccacgtgccagagcgcctgccagatcgccgaggcgctgcaaatcgtcgccgtaggtgggatgtacttcgccgctctcgatgaaggccgacagatgatcgaacagattttcgccgagttgcgcggccatgatcgtggcaaccaccattacgtcgccgatgccatctttcacatcgaccgggttgttctgaacccaggcttcgcatacttctgcgaactcttcgaccaacttcaggaattgatctttcgcagacgagcctttgatcaggttacggtcggaagcccatttaaccaccaggtcgtgaagttcgcggctcatgatttgttcgatgttcattctttcgattccttctgtatttgggatttgactgcgttgatgatggacgccgtgctctggcgcgatccgtccttggttgtgccaaaatagaaggccataacagacttcagttcggcgaaccaatagccgatgatggtgccgatggcgacagaggaagtcgggtccatcagcgcctcgcggccgaaggtgaagattgcgatgatgatgagaatggagcctgtcagaagagcgaatgtaatcgccgggcgaacgaaatcgttctgctgcgcggcaagcctcctcgccgaatccctgtctgccgcctctgcggcgaactggctaagctcggcctggagctgattctgctcagactgaaggcgattttgttcggcttgaatcgcaagctcctggagacgaacgcgctcggcgctctggagttcggcgaggcgcgctagagcttccggattcgcgtctagagcgctcgcgactgaggctgggtcggccttcgaccccagcgccgtcgcgacgatagcgccaacggcggcgcctgcaggcccacccaggagcgaccccagagccggggcagccgcgccgatcttactacctatgtctttccagtccatttcgactcctcaaaagaaaggcgccattacagcgcctttctccggccggtgatttagaactcttcggcttcggtcgcatcgccgacgccaccggcgtcactgcgaggctgttcctgcttgctgtagtccaccttcacctcgccgccgacgaacgacttgtacaggtcggccgcagccttgaagtgatccgggttcttcaccaggccttccagctcgaactggacgccggaccagctacccttgtcgttcgacatgcctacggtggtcatacggaccaggttggcgaaagtcggcggggtgcgcaggccctgcggggtctgaacctttttctgggacagcgcggtcatgagcttcttcgaggccttgatctgcgaagacgacagggagatcagagcctggccgaaatcgccggtgtccggatcgatgacgatgacgtaatgaccacgggtgtcggcgaagtagtcagacttcttgtcgctgaccgaaccgtcttcgttcggcgcgtacaggcgtccttcgacttccttcaccttggtcgggtctttcatcatttccttgaagtcttcgacgctgatggcgcccttgaaaccgccctcggcctcgcgaccggcccagcggatgaactcgcggcggtacgcggccggaatgatcagcaggccggtcttgccgtcgtaaaccttgccggtgacggtattcaggaacatgccggccttcgcgccctcgatgtacttcggatcgtcttcatcgacctgcggagacatcttctgcagaacctggatgaaggggatggcataggactcggcatcggcgccttcgaagcctgcgccgtcatacgatcccaaatccatgaagtcgggaacttcggtagttgcgacggcgccgccaccggtggcaacttctacggccttggtttcttcggttgcttcggaagtttcggttttcttaccagccatgttaggctccttgtttgtcgaatttcagttatcgctaactgtgggtttataataacggaagttgcaactaagtaaagcaaattacatatcaagatttgctctttttcaccttcggtttcgtgatcttggcctctttgtattcgtgtacgccgatgaaatctggcagctcttcgcccttctccaggtactcgcgaccgaacgcctggagggtctggtaatggacatcgcggttgatggtggcgtcatagccggcttcgatgatggcctcggccgccttcttcgcatcttccatttcgccgcgaccgaattcggccagaaccttggtcttgatgatgccgtcgttgtcggtttcttccagccacttccagaacttcgatttgttctcttctttgacggaaatgatggccttcggctcgactttgaccgtgcgaccgtcagccagagtagtggtcttttgaccaagctcctccagcagctccggaatggtgttgcgcttgagggttttcagctcctcttccttttcggccagcgccttttgaagatcgaggatttcgacgtccagctgcgaagccttgtccaccaggttcagcagtcgatggccgatgtcggtggcttcaaccgccatttcatccatgacgccaaaatagtcgatttcgcccggcgcgttctctttcaagtattccgggatttcaagctcttgctctttcatgtccgcctccaacttagtgatgttcccttacttgaaccaagtattgagtagatattatgccgcatcttccttgatacggctactgatttacatattaaatttcgtcgcgagtgctaacgtcagcctcaaacacgccatcaacgacataacttgccaggttgcgtttccactccaagctgacctggattttctcgtcgatggaatccagacagatcaggtcgaagtacagaaccgagttgacggtgccgattcgatgatttcggtcttcggactgcatccgcagctcgttgtcttcgtcggtcgtgtagtagatggccacgtctgcggctgtgagcgtgatcccgatccctgctgcggccgggttgcccaggaacacctggacgcgcttggcctggaaatcgtcgatcaatttttcccgctcggcctctttggtctcgccgtagtaggtgccaaacgaaatcccttgggcctccaaatacgccttgatctggtcgatttcctgaatgcgcatggcccagacgatgatggaacgctccgggtcttcctccagcagaccctccagaagatcagtaaacacggcgaatcgcgggttgtcttcgggcggcaggatcaccggctcaccatagacgttgatatagccggacgccacttgcttgagtttcgagcgcgctgccgcggcatcgaaagatacatcaagcatgaaatcttcgttctggagaacaaagtggtagtcttcttccacgcgctggtaaacctttcgttgctcaggcgacatttcgaagtatatgcgcttgtacactttgtccggcaggaatgggagtgcttctttcttcgttacacggaaactgtgcggctcgatcagggaccgcagcttgtccaggttccggaataccgggcgcccacactcgtctttttcgaccagttgcggcggcatggtttgcttcccttccagcttgcgcatgatagcgatcattcgaggatcgtcactgggcaccaagacggaaaattcggccacaaacgcccgataggatttagtccccagaattccattccgcaagaattggaactgcatgaacaaatcggtcggtgcccgcgtcagaggagttccggaaaggatgcgacgggccacggccttctcgcccagctttacgatctttttcgcacgcttggcttgtgggtttttgatcctcgttgactcgtccacaattgcgcaaactttgaatgtatcaaggaatcgctcgacctcatcatagccagcctggtggttgattgcatcaacgttgatggcgaagacgcgaagaactttttcatctgcgaacgtctcggaatacagacggtccaagcgcgccctggcctttttggaagtcggtcggccgcgccaatccacgctcaaagtcttgatcgcgacgtgggtgggaatctcgcgcagaatccagttggtgtggacgcctttgggggcgacgatgagcagcgcgtccacgcgcccctgtaggaagaggcgaacggcatcagccaaagtcgtccaagtcttcccggtgccctgctccatcaggtatgcgaagttccgtttgttcagggacgctgccagggcattgaattggtgctgcatggcctcggtcttcatgcccttgacgggatatgttttggctttcatttgttctccaaatcggcgaggaactgaacaatgttatccagtccttctgcatagctcgcaacttccaccaagtcgcggctgttaagctcgaacaaatcgaacataggattcagcagcagccaatcggttccgatcttggccaggacgaagccccggccaccccagccgatccgctcccgaagaaaagggatttgcccaggttcgaaacatctggccattgggcaggtggaagcgcgtttcggccactcctccaaagccttgaactcgacccagaactggacacctcgacgattcaggcagatcgaatcggacatgccagaccgccgcgtctccagaaagtcgatcaggattcggccgagcgagcgctgcttaaacgcattcgccgctttcgtttcgcgatcattcatcaccttcgccctctttggaaactttctctgcttgcgctgccaactttgacttctcgcgctcggtcaatatccgcttgacggccttcacgatgaacatgtcgatgccgctgagcctccatcctttgatcaggaaccaagcgccggtcggcgtcccttcagcaatctgctttccgtattgcagatatttttcaggccgaattctgaaacgtatcggctgatcaaccgagtcatcaacgcacatgatgtcgagaaactgcgactggcccttgtacaccgggtttttcccttgatcagccctcttcttctggcgaatcggttcgttctcatcagacagaacttttttcaccatcttgacaatgaccagaccatcatctccatcgcggatatcccgaatgttctgaatggggtttccggaagttactccaaccagctccggattgtcataagcatgaccccagagcgtgtgagcttcgttcaaatctgcgaattgaacttcagaattcgacagactcgcggcgactttctcccaatcctgaagcgtcttcaggtgggtgcctgccagctctttatattgagccttcagctccttaagatcggccttcaactccttcagatcggccttcaacagtttctccagttctttgtcttggctgattttcgccgaaagaatctgggcttccagagctgctacatcagcagccttgtcctcaacatcctgtgccgatatcgggcaattggccagggcgatcctcgcggccttgacttcctcgcgaagacgcaggaaccgctcggccttcgccgggccgaagcctttggcgttcatgatgccgccgatcaagcgtccatccgccactacccagttaagttcggaatgctccgggtccagggccgtatattctacgccttccttggccaattcgcgaagtatggacacagtttgctggtcgtctttcgccgcccgaagacacgcggccgcgtattccaggcgatgatatcgcttcatgtagcaggtccagtacgtcaccacagcgtagctgaccgagtgggagcggttgaatccccaggcgccgaacgttaccatttcctgccaaacacggtgagcatcgtccggggcgacgcctatggtcttggcgccctcgatgaacaattcccggcgcttgttgaaaaattcttcgccctttcgcgcagacatggctttccgaatcgccgacgtttgttcccagtcgaactgcccaatgtccttcacaatggacatgatctgttcttggtacaggaaaactccatatgttccagacagatactgctcgacctgcgggatggtataggtcacaggctcgcgaccggccacgcgctcgatgtatttggtggccatgcccgaagacaacgggcctggacgggcgagcgccgttatgtggtcgatgttttcgaacgcggtgatattgatcgcattggcgaccgagcggacggcctggccttcgaactggaagatgccggacatcttgtcttcgttgagaatgtccagaaccgccttgtcgttcaacggcaagtcgtacagctcttgcgccgtcacgcaattagcatcttggatgacgcccagagttcgaagcccgagcgcatcgatcttgagaagattcagatattctgaatcgggcttgtcgagctgcgcgacaccttcagaagttaccgtgcagaagtcgatgacttcatcgttgcagaccaggatgcctgccgcgtggactccagagtgggatgggtgaatttcgaggtcgcccatgcaggcggacgcaatctcatacttttcacggaagtcgcggccgggttgagttttttcgaaagtgtcctccaatccttttccatatcgttcgtccgccgatgtatattcgatgatcgagtttttgatgttgtcggtatcgtggaaggggatgccgaagcgttttccgacgtgagcgataaccgacgcggccttgagtgtgttgatgttacccaacttcacaacgttccaagtgccatacttctgctggagatattcgaacactagatagcgatgggtatcggcgaagtcgatatctatatcgggaagatcggaccgggaaatgtcgataaagcgctggaagagaaggcgatgagggagcgggtcaacctcggtaatgccaaggagatagcagaccaaagagccggccgaagagccgcgagctggaccgaccagcatgtgcttcttggcaaacgcgaccagatctgccacgaccaggaagtagctgtcgaaatctttcagctgaatctgcttgatctcttcttggaatcgatcctcatactcctgggtccattccttgatgtggccgcgactgaggcggtaggcttgcccctcgcgagccagagcgacgatatcaccatccaagtggatcatcggcgccttcgccagtttcacatccgccaaccgctcgactaccgcacgagtattggctgcggcagtatcgaactcttcgcgagtcatgatgtggcgtaaacggctccacagctcctcttcggtggcgatgtggcgaaggccgaccgattcccgcaccttccaggccgacgcgaaatcagcatggtcgatggacggcatgtcgttgtaagaggtaattaccaccggctttccgaatgccctggccgtctccatagcgccgtgcgcggcgaccatcgacgcgggattgatgtcaatgtagtcgattccggccagatccagatgggcataggcctcgccagcgaatttgatgacgccgtcagcttcctggaattcttgcggagtcaatccttgattctggaccgacttggaagtcaagcggtagaacttcttggtgtccttggcgagcacccaggctttgagcttcagctctttctcgccatcgtcggcgcatttgatcgggatttccatgccgaatccgcgaggcagttctgccttggtagcggcttgttcccaacggacgtggccccatgttccatcatcgacgatggcgacgaatggggattcgatctctttggcgcgctcgatgatctccgggaatcgaccatatgcggcgccgtaggagtaaccagagcgaacgcggagctgagggaaagacatcatgcggcctccattgcttgatacgcccgatacactcccatgcgcttgcagacttcgtggagcagccgcacgtcgtcgagcgcccggtgtttctgtacatatggtccgcagtagtgctcataaagatgttgcagccgcatgcggtggccgaacaacggcgccgactcttccacagtacagatatcgagcgatgggaaattgacttcgtccaggccgaacttgccgcgagccagatcgcaggtcagcatgaacttatcgaatggcaggttgtgggcaatattcgcgtcggctctggaaaagaagtcgcgaactttctggcgctgatcgaggaaagatgggtgcttgaccaggtcttcgttcttcaacccggtgatcttggtgatgatttcctcgataacgattccaggattgcagatgaactctacttcatccaaaatcttttcgccatcagttatcacgccggcgaattcgatgattctcggctgctttctcagactcaccctttggtggaacgggagtcctgtggtctcagtatcccatacagcgaatatcatgtttgttccctcttatgtcgaaaggccggctgctttcgcgaccggcctgaggagtataccgcgacggctgaagatttacgccttctgtccgtctttcggcgtgatgcggccggagcgcatggtggcgtgaacaaacgccgaatagttgatcgagtccaaggccgaatcggcatccttgaacccgctattcgccaggcgagtgagtttacccaccatgtgcatcacgaacagggcgagtcgatgatcatcggcggtcttcgccaccaggccgttcgggaagaggatttccatgatctttccgtacatcagatcattgcgaccataggtgctctggcgggcgcggaagacttctgctgcggcgtacagattgttgagaacatcttccgcgaaatcatctggatgggaatcatcttcgcccggccagacggattccatggcgaacggcgcggcgtcttcggtcgggtcttcggactgagccgtttcagcgagcggagacggggctttcgcaaacgcctcgtcgagggtaggggcggagttcggggcggccaggaacggctcgcctgccatgtcgttgggcgcgctatcggggtcgctatcggccgcgacggcgaagaacggcgcatcgcaaccttccaggttcaggatgtaggagtcgatccccaggctattgtaggcatcgatgatgtcctggcgatcatcgaacgccgcgacgatcttggtgacgccttcgattttcttcaggatgtcgagcgcgactgcccgcttgaactgaggcgccggctcggtgttaccatacggccgcatgatgagttcatactcgcgatgttcggcgatgccgagttcgcggtggagcttggccctggtctggaaaaagtggttgtcggttcggccggtgacgaagaaaatcatgaggtcggcgtcgatggcattcctgatgcgacctacagcgtgcgggttgagagtgtccttgtcgagacgagaatgatactcgtcccattgccgttccaaggcgaagctcttgcggtggctatcgtcgaatacgcagccgtccaggtcgaagatgatgatgccattctttggtttgcgttccatattcagatttccttactggttgctttctgggtgacggttttatcgatgaacgtcccatcagaagtgaggcggaaaacttcgccattctggatgaaatcgaacgattgcacgttcatcgtgatgcgaatggattcgctgccgttggtcacttcgacttgtgcgatgtcgccaactttctcgacaatgatcttcatgttacatggacttcccattgacggccacagggttggcctcttgtttttccgatccccagaaatcgcggcgcagttcttcctgctcggccgagcgatccatccaggggcgatagaacttgcactggtagataggttccaacggaacatcaatcacaggaatctgacctggctttgtctccagagcggccatgaaccggtcataggatttctgctggatttcctcttcattcatcaccttcgacccatagcgcgggaaggcgcaggagccggtggcgacgcagtgcggctggagcaggctgtcgaacataggatagacttccagaaccagccggcgcatttcgcggaatacttcctgatattcaccctgggtccgaacgcacaggcgaaccttcgccatgtcgctgagagtccgcagattgaacttggccgcgatcttcgtttccatgttggaagggatgatggcacgagcgtcctggagcgacgcgccggcctccagaagcttctggtagctggtttgcgcgtcggcaatggcgtcatgccacagacggttcagctcttcgcggacatggtaggtcgggtcaggctcgccatttaccgtagccggttcgtcgaattcccagcggaaggcttccggctgaacgacggcgctgatttccagagcgcgactggtttcctgctgataagccccggtacgagtccgaacgagttgatgggtgaagttcttgctgacaccctcgatctggaaaatgaagtccacgaactcgaacggcgagcggatggtgtccagcatgtacttccagtggtcaagcttttcggcctcggtcatggtcgccgggtcttggccgcgcatgcgagtggatttcgtccccaggagaagttcccaggcgttctgggtgtaactgatcagagaaattttcatcagaaatcttccggaattggcgtgaagtggaattttttggttagagccagggccaggccttgggcttgctctttacgaaggccatactgctctatctcttccttgagcagttcgcaggcctccagacgcgactcatactcttcagcctcctgaacggatgagaaaacggttccaccagaggttcggtacacaagttcaatcgacatgatgacctcagtagcagcggatgatttcggcgcggatatctcgacggtcgaggtagtgctcacgaatcttatcgcgggcgcgctcggcctcttctcgactgccgaacgacaggttgaacgaagtgaaaggcttatcgtccagttcagcgccggtttgatacaggatgcctaccagaacgaaagacggcgcggtcttcggctgctggtcggcttgcatttcgagttcgaggaaggacataggaacctcttcaggatgatctggtgcgtaaattaatagcgctcctgctgagcagctacggtttccggctcgtagatgagcatgtcaacgatttccgggcactggcctttcacccagtcgatggccgcgaccagtgtggtggaagcggagaaagagaaagtgcggtaagactcatggatgtacggcgaccccatcgaatcgcgctcggtcgtgcgagaaatgactgctttgatattaacgatccggcccatcttcggcctccactttagcgattatatctgacaggctcagcttctcgccattcaggaaataactggcgcgaaacttcctgtcaccctctggcccgacgatccgggccgttatggtgagactcccgccgccaagggcatcggtgtccctgaagaaagccagcagcgcccgcttgagcgctgcctcgcgaggatcgacggccattaacctaccacgttccagccgtgctgagcgcaccaaaccgcaccggcccctgcaggaaggctattcagaaggaacacaggagtcaggcggccgtcctcggtcatatggatgaagtagcgggcgccttcaccgagccactcggccttggcgatagcgcgttcgagattggccttggtggcgtaggttttggtgtggttcttgtcggtggagaaggttacttcgcgggccatttgtcgattccttttggttgaagggtttcgcgtttcgatgagggaatattacgcccacctgatccagaagtaaagcacttttgtaaattacttcacgaacatccgcttggccttctgataagacgaagaagtcatcaggcgctcgatgacgtccatgtccgaaaccagatcgtccagaaggacgttgcgccaggtagcgaaccggccgagcgagaagatgccggcttcatgggtgagattccagatcatggattcgcgctcgtcgcggccgagcggaacgattttgcctttggtctggatggtcggctcgccgtcctcgattagctgtttccttctgatcccgaaggccgcgcagacttcatccaggtcccatgccggattccattcgatggtttcgatctcaccatcagcgttctccaaaacgccattcgcgacggattccacgatcagagtatcgccggtgatggacgcgcgaaatgtcccgaagtcgggactggggaaataaacggtctggaagacgtcacaagggatggaaagcttgtatcgactcacgatgatggatgttcctttgccgaatgacgggtcgatacccaggtccatccccgcagcagccaggttggcgcggaacggcgcggtgcttatgacattcacatggtcatcttgccggcgaaggtactggaagaaagaggcgtcgaaaggacggctccaagtgatacgattcgcaagcttagccaccagcttctcatagtagtcagccggtgcgatccaacgcttttcagtcgccagattccagatggaccggtccgacaggccgcccgttactttcctggagtacatgttgcagtggtcgatgcgcggctgggaaatgaactcgccgtcgatgtagatagctttgtgtacagtgacttcgcggaacgggataccggtgagttggccaattactggcgagcggaatcgcaagagggcgttgtgacgctccttgttctccggcgtcgccgcgtcgatgatttgggcttgaggaaagcgatgcgcggcgatcagtccggcgagtccagcacctacgatgatgactttctgatcaggaatcatgatttgttccttctgaatgtacaaaacttgagaggataaaaaagggacccattttcatgagtcccttgaagagctagacgattcagtctcagaagagcggcggcttactcttcttcaccatcggaaccgtcggcgccctgatcttcaccgtcgtgctcctggccttcatcaccggccttctcgtcatcgccctggccagcttcgtcttccttcgaagcgatggcaaccagatcgacccagcccatgacttccagcttgctcagatagctgcgaaccgaggctccatacagcaggtgtgccactttctcgccgaaagcttcgatttctaccggctcaccgacggcgcagttctcgttgatgtaggcaaacaccttgccgcgaatcgaaatggcctgcggggtgccatggccgtcgccggtcgggatgaagtgggtggcgcgggggcgacgcgagccgttggacttcagttcttcacgacgggcttcggccttcgcacggcgctcttcctgctcttccttgcggcgctgcttctcggcttcgcgctcggccttcttctgctcggccaggcgcttgcgctcttcttcacgagcgactttctgagcttcctgggcggccttcttctcttcggcctttttggctcgctcggcttccttctcggccttcttctgctcgcgctcggcttccttggccttcgccttctcggcctgctcggcttccttcgccttggccttttcagcacgctcggcctccttggcggcggccttttccttcgccttctcggcgcgctctgcttccttcttctcacgctcggccttgcgcttctcttcgcgctcggctttcttctgttcggcttccttggccttggcctcggccttctcggcgcgctcgcgctctttacgttgacgctcggcggccttctcggccttgcgcagggcggctgcttgttccttggtcagctcttcgccttgggtctgttcgttctggtccatgttcttactccgggaatgtttgaaatgatggcttattggcctgtgagaggattatctctaaactaattgaagaagggaatacctttcgcctgaacttctctaaatatttttctttcgggaaagtccagactccagggaacttatttatgttagcgaagtttttaactcttacgcaaaaacaacaagtattcaattgcgcgagttatcccagtatacatcaactgactataagggatggacggcaagttttcttccaacatggcgacccgtttccattccgatccctgcgacttatggaacgtcatcgcccagccgaagtcgaatccgccaatggccttctgtgcctccagccgcacatcttcctcaaccgaaaagctaagaggattgaacttcacccagcgctcatagttcgtgccgataatgcgaactttggcaaacagcatttcatccggctcgtcatcatcttcttggccttcggggaccggcttgaagtccagcagaattgcttgctcgccgttcatgatgccatattcgtgctggttcccggtgcacaccagcttctcgccgatttccggttgtacacccttgtagccgaggatgcggcgcgccctggcgttcaaacggcggcgagtattgttgtaggcgcaaaggatcacgccatcatcgtccaagaacgtccgcatttcgtcgtccgacatgtcgaatccggcccgtaccaggatgtcgtcatactcgcggcagggtaggcgcttgccctggcggacgaacatcgacgcccgaacgatattgccggcgttgcgctcgatttcggtcatgatggtgtcacagctgttctcatggaaaatctggacgccgcgcacaggaggaacttggccaaagtcaccaatctccagaaccggaatccggtgcgacagcaagcgctcttcatcccactcgccgatcatggacgactcgtcgagcacgaccaacttcggcttctcgtcgagcgagtctttgttggcaaacatgatttcgccgtcttcatcttcaccaatcggccgatagatgaagctgtggagggtccgggcattggtgcagcccttctcgcgaagccgcgctgctgctttcccggttggcgcgacgaagactgtccagtccatcgagcagcaaagttcggcgattatcttcgcgatggaagtcttaccagttccggcgaaaccagcgagtctatagacctggcggcggtgcgctcgatcacaccaaccgcgataccagtccacaacggaattgatcgcgtcgatctgctgactgtttggtcgaaagccgaatcgctcttcgatctgatcgacggtgaagttagatgctgacatatttgcgttctccaacgctaggtttaattgaattgaggctcagtttaagcaagccgtccacagaccatccagtatcacgacgatacttgcggccgtgcggatcgacatagaagtttttcgtgcggcgcagcagaacataatgccaagcggcgccgagcgcgtggactcttcctttatatgggaaggccttcgcctgctctgcggcctccttggccccagggagccagcggacggtcgaaaggaccaggaccgcccccttaatagcctgggaagcggcgcggccgtcctttgggctatagcgatgtctatcgaagtctacccagtggtggttgccgcgccggagcttgaccgttcgggatcgcccctcgaacaccacagtgccttcgtgagttaaaatatgttccgccatcgaatgttcctttataacgtacagttatgctttacctctgcgcaggaagagtatactatcagctgactcgccaaagcgagcgaatttaatccaactttacttcggcaggaaagtggccgatactagcgccgccgcctgtactgccctccaaaacagaggatacattaaatgcaagaatgcaagatttaccgcgaccaactcccggtcggtaacccgaatcccaatgtcgacaagacccgcgacccgaaccttaagcccggtttcctgcgtcgcagtcgcgagctggacccggcgctggccgttcgcatccgtcgcgagctgatccacgccgaagcatccgacttggccaaggccggatgggtcaattcacagtccagcctttatggatcgaaagccttcccgcgccattccgtcgttcgcgtgaccggagttccggaagatggagctttcatcggcatgctgatcggcttcatcgagcatcgcgagcatggcgaatgggcggtcatggaagccggaacgaaagaaggcggcgccgtcattattccagtcgatcacatcatgcgagcgtcattcgccgaagccgaagagttctctgaaaagtgggagcggaacctgggatggcgtctgctgcgccagctccgcgagtgcggcgcccttgccgggactgaagacgagtttctgcggcggatcatcaatcgatacgttcgtgatcgcacgatcctcgatcaccacaaagtcggcgcggacaaaatctacactgatgcagtgctcaaaagcatcggcgaaacatggccgaagattccttcggggaaattcgtcggacaccgagtcgcgcagctcctgatcggccacaagctaggtcgagcggggaccatcctgaatgacctggtggacttcttggagaagttcgcggccgggcgcgataaagttctcaacatcgccatctgtaattgaggtgaatggcatgtataataaaccgactttgaatcaccaccatcaaaccgcattgttatatctgtataacaatcccgatcagccggccttcacagaccccaacaatcaggcgctaaatgaacttcggcagatggggtatgtaaaggcgaaaaaattcgaaaactgggcaggcaccggccatcttaggatggaatggacgctcaccaaggccgggattgagcgcgtcgaagtcgggtttctggggaagtgcgccgcttgcaagggaatcggtcagacgttgcttcgggggaagtgtactgtttgcaatggccgcggccaggggtggatcagcgaatggtcgcagaagccaatcgaagataatcctcaaatcgtcccaaagttcgaaaagacagatgcgaatcggctagcagacgccattgaagaaatcgcccggctggaaaaggcactggccgaatccgaaaagcgcgggagcgaactggccgcgagctattgcgatggcgtgatcggcgatgaatacggccatcctcattgtcgttataaagtggagcgcgacgccgccctggccgaagtcgagcgcctgcgagaatcaaaaggcgatccctctggcagcttcgacagatgtatgaagatgatgtacgagcgagacgagaaagcaaaacagctggaagtcgccctggccagggtcgcggagctggaaacggctctggcaccattcgcagcggttgcccaaccacagccgtgcacgcaaccacaggcccatcctgctcgctgtggttgcgagcggtaagtgccaagtaaggagttcatgtaatggaacataagaaaccttcaccagtagatggagtcatcatgaccagcctcgacgttctccggaaagcgaagcccgaagcacaggacgagtatgccgtgtccatgttcgcaacggcgattcgccagaaactgcaacgctcccgcgataaaggccgaggcggctggatcgactgcgacgaagatattctgatcaacggattcgccgaacatgcgctgaagggaaatgagaacaacctcttggacctggcgacgttcctgatgttcatgtgggtgcgcggcatcgatgatgcgaagattcccccggcgctcgaaaaggcgcgacagcacaagatcatggaagcctggagtcgaatccatgaagatggcctaaactccgccagaaaggcgagtgctgcgcgacagttcgtggaagtgcctcgacgcaaggggcgcccggagcgacttgcatgaagcctcacgaaataagactggcacaggccgaagagttcctgcgcgaactcggccgagggattccggacgacgaacgggtaatggtcggctacgctgaagaggccacagtccaaaccgacgagaacggccgcaagctcaacgccggctggtggcccgtgccctggaaggaaggcaagtacatcaattccagatccaacgcatatgcctgtatctcgtcgtccatcaagacgccaaacccgaagaccggccagatgcgatactggcgcggcgaggcctctttcggccacggcctggcgttaatggtcgatgacatcggctccggcaaagggtccaagggcgacttcgaccgcgacgagttccgcgagcgcctagagccgaccgcgattgtggagacttcgccgaacaactaccagttctggtatttcttcaaagagccgatgtcccacatgctccagttcaaggcgctgctctattcgttcgtggaccaggtgctaaagaaaggcggcgacaacaccgtcaaggacgtcagccgttacggccggatgccattcggcttcaacaacaagcgcgggaaagacggcaagttcaaatatgccgacgaaaacggcaagcccgaactcgtgcgactgttcagtgccgactattccaagcgctactcgccagaagagatcgcccaggcattcggcgtccgcatcatcatgccacagatgaagaaggtggagataaaccgcgacgattggttgtatgaccaagtatggttgaagtatgccgagcacatctgcacgaaatacaagatgggagaagcggcaggcggccaggtccagcagaatatgtccggcaaataccgcatccgctgtccctggggcgacgagcacaccaacggcgatcctttcggcgcatactttcgcggaccgatacctggcgccgagcacgaatatgtgttcggatgcgggcacgatacttgccgcaaagagcatcgacggacatgggcggccttcaccgatgaagtcgtgctaccctatatcgtcgaacaattggaaagaatcaaccaccgtcacatcggtgaggagtagacaatatgcaaaacgatcctggaatcctgatcacggccattggcttgctgttcctcggccttatcatcttcttcgaaggcctaaagggatggaaaatacaagtcgcaaacttcctcgcgtcgcttctgtgctttttcttcggcctttctgctttgacgttctggttcgtcgttgcgtttgacgtattttaatcgacgaacggtacagaaattttcggatggggacggaacttattagctatgccggtttaggtaggagataatagccgtccctttcgcctcaatatgtagaggcaatgttgaatccgatcatgtaaagcagaaggcggcaaacctaacatgattatcgacgaagataatatttttgatgatggcgaatcagggtccagtgagtttgatctcacacagatagaagatgctggaatggaccctttgatgaccgccgcaagtaaagcggccgacgatgcgattgcgaggaatgagacgtaccgagcacaaaaggcagcaaagtatgccgaggcgtatgcggaaccagatttgaagaagcgagcgcgattgctgatgctcgatcaggcctttgatcttccggtcagccggctggtgaaaggaccgttcgatgacttcatcaccaagtacagctcgacttcagacagcaactacctcgcggtctatgacacgttgttctgtaagggcgacggaaccgtcccacacccgcacttcgacgagtttcgcggccggctggtggaccatcgcggcgtggcgttcaacaacaagaccctcgatccgattgacctgatgggcgccctcgcggctgcggccttggacgatccctcgattaagaagacgattgagacttgctgcgtttgggcgcgtcgatatcgccgcaactcgctgatcgagacgtttgagaagaagataccggattgggacggcgaagagcggatcgaaacgctgctgatcgacttgttcaaaccgttcgacaccgagcttaaccggatggtgagcaagtatttctggctgagcttgtactgccgcatcaactaccctggaatctcggcgccgatctcgttggcgttgattggtgggcaggatgcggggaaatcctatttcggcctgctgatctgcaaagaactgtctggcggtcgcgatctggctccagtccagctcgatctgagccgacacgaccagacgccattcctgcgcaatatcaccggcaactcggtcattgcgaacgtcggggaaatgtccggcttcaaaaagggcgacatggagcgcatcaaggagttcttggttcgttcttcggatacattcgaccagaagtttgagccgggagaaacgatcaagcggcaatggatcaccatcatggacggcaacggatacgatggactccagcgggacgactccggcaaccgtcgattctatccgatgttcgtggcacaacttcccgacgaagatggaaagccgaactgggttaagccgggcgatggtaatgaaccgttcaaggtggacttcaccgacttcggccgcaaattctggcaagcgatggctgaatgccgcgcatggatcgaagagcatggtgtcgatggatacctggatatggtgtcggaagcgaaccgcgaagtgcagaagttctctatttcggaaatggagaatgcgcgtggcgtggttcgtgatgacacgattgatatgtatctgatcaacgtgctgatcagttgcgagttcgaagagatcaagcctggcaggaattcaaagaatcctggatggagagttgacactgtagccattctgaaatggttcgacatcctcgccaggaagaagccgatttctcgtcaccttactccgcacttgaaggcgctgggatttgtcccgaataagaacggcctgaatggatggtgcttacctgtcgataaggttgcacctggatggacgaagggtatgcatatgacactgccgccgttcaatgatgcgcttgtgtacttgctgagaaagggcgacccggacatcactgatgaggctgcaatgacaaagattcgggcggtacgggccgagcgagctaagattttgggcgaggatttctgatgtagtggtggagtgtacttggactaggccgccttcgggcggtcttttctttggtgcggcgtacattcgatttcggtggcggccgagtgagattcggaagctatccggtaattaggatgggatggtggtggcgtattgtggaaagttcgtggatggtggatcgagaattttgtgtggtgagggggtggattatggaaaatcgacgattctgactggatttttggggtcggccgcgtcgagcttaccggtaatttacgaaaccaggaattagggtcgagccttagtgccgcgtgggcttgaagcgctttcccggatactttccggattcggaagcagccgcaaaactatactacagcgaaaatcgattgcacaatcctaatagaaaaaatctatcacggacgttacctatctttaaaattaataaaattaatagtaatttggtaatttggtatactttagtatttgaaagccttgcggcactaagcctgtacacttcccgtcaagtttccgattccgctcaactcgcggcagggtcgccggaaacttccggacttacaatccatgggtcgcggcaacaccacggcggactaagcggcaagtgccaaaactcgacgaacggaaccggaaatttgggagcgcgacagaatagctcagctggacatatttctaacattcgatttaacactcaatccaaacactcaccaccatcgtctcccaccaacagccgactcgaccctcacccaccagcagaccgcccatataacatcctataacaccacctaacactcattcaccatcaaacccacccagacctacagcccacccacaagcagcccatagacgcgatccctggccccatagtacaatcgcgccatactcagtgtcgcggcagagcaccaggggccatccgccaaccaagccaccacgacgactccagaatcgaactccagggacgcagcaacaaatgaccgccaaattctacagccccgacgatttagtcacgccacaggaattcgcagacccgcatttcgcggcgatcaaccaaaagcgattcgacctgtacatcgacctgcgcgtccaaggctacagctcctggcgggtcttccgagccatctggggcgaggagcatatggacggtcccgctcaggcccgcatcttcgcgatggagtccaatccgtactatcgcaagcagttcaaggccaagttgaacgcgaccaaaacgtccgacttgtggaatccaaagacggcgctccatgaactcctccagatggttcgcgacccaaccgtcaaggattccagccgtctgtcggccatcaaggagttgaacgttctggctgaaatcacgttcgtggacgagtcgggcaagaccaggatcggtcgcggcctggccgacttctacgcatcggaagccgaggctcagaccgcgaccgtcgctgctgcggccgaagccaatggatatgtgccggaaggtgaagagggagatttcccgtctccgtctccggaaccgaccgaggaagaccgcgccaaccccatttagacataaaataacatcattctaggcccgaatcggaccgaactaaggcgaaggtagcgggaagggacgaaaaacgattctagggcggttctaggaagttgacgcctaaccctcagaaactacaaaccccggactctagttcagaatccggggttttcttttggggttcttattcgccagtttcgatgatttcgaagttgtatttgacgccttcgtgctcgaaggtcaacttgcctgccgctttcagttgcatgcggaatcggatgcacttagaggaaggcaaaccgaactcgatgaaggctgcgttgcaggatttgaactctccgcgcttgcctttcacggtgaccgctacgccatgacgctcggtgcgcttgcgggcaacttctgggtctttccaggagttggctatggctgctgacaggtctttggtctctttggttttctccggcgcgttcttcgcctcttcgcgcattttccggatttcttccagcgcttcctcttcggtgatttcttcttccggcttcagattctcttcggccttctcttctgccttcttcttggaagtgcgggttttgtaaacctttgccggggcttcctcttcctggaaggcttcttcctcggccggcagagcattcaggatggcgaggcagcgacgctcagcagtcttgcggtcagagaaacgcttgacggtcgcatcggcgttgtgggcgttgtagaaggcgaccagttctttcatttctgcgtcctggatgtcgccgaaggttttgatggagttggtcattttgcgatcctctgttttggaagatttcgtttgggcttcagtttgtcgccccgttgaaagagattatgcctaggtcgatgctgcgtgtctacatttatttagcagaatgatggtgaacccgacgaacggtcgtcggatgtgaaaacaccgcagagcaggctgcggtgtttgttggcgttggggtgatgtcagaaagtcgggacggtgataggctcgatgggcggatcgccgggcctgtcgttgtccgatgcgggcgccgggctggaagggatcgcacccgaccgaagcgccagcgattccgactgcctgcttacctgtggagctggaggagccgctggtgcctttggagggattggaggcaggtcatttcgacccttgaccatttgcagaggttctggaagatcgggaagcgcgccagcgatttcgccatacgtccgcgccggatcgtcgccgaacatttcggcggatcggttatctttgacgatctggctgatggccgtcacatcgccgcccggttctgcaggatcgatgcccacgaatggagtggtcacgcagcgcatgttcggatgggtaggcagatttttcagaacgatggagtctgcccagacatacggattcttgtggttgccgggtccgtggctgatgatctcggcaggaatatggccgttcatggtgagccattccgccatcccttgccgagtcagcgggcttaccacgatctggccagtggactctttggcgatggcgaacagatcaccgaattcgaatccaatgattgtgtagttggacctggactcgccgacgaaagccagagtttcgatgttgtggtggatatcttgttcttcccagatgtaaagcatgatgcgctcctcaataaggctgcttgttgtattcgaccagagacataccggccggaactttgaagcggacgtattcgatcatcatcgccgtgcgacgccgattcgtgccagactcgtcattgacgaagagttcgcactgatgcggaatgactcgcgtcaccaggccttcgcctttcgagccgtagaacttgatgtaggctgcgacgcctcgcgtcatgttcagacggatcgtttcgcagagtcgctgcgcggccgacgcgctggacagatcggtcggactgaccgtcacccagtaatggccactttgttctttatcggacataagctgccctccaatgagaaagcctctgccgagtcgcataggctggttgttgttagtcgcgcttcaacagaacgactttgtcatatgcgcgatatttaccgcgccagtcttcccagtagtcgccggccgggcaggtaagctccagggtgatttcgtcgcgccagcattcgacagaaaggacaattgccttgttcctggctgcggaatccgccctgagcttaatcagaatttcgtcgccagttttcaactcatcaactctcacaactttggccatgacacactcctgtttgaagaggcgcggccggaaccaacccagccgcgccgatggattaacgtttgtgaaggatggacactgcgtccacgtcgaggatgctgatggtacggcgacggcgcggattgctgcgttcatggatgcgaatcaggttcgcaactggagcttcgtccaccacccatacatcttccggcttctgcgtccggagcaggaccgtcacttctgcgttctgggcgaggccgttgcagatgaacgtgaacttggacgagggagttctgtacatgtcgagattcctttttggacttcgggtccggcttttcagtcggtgaagagattatgcctgatcatcaccgtcgagtaaagcacttatggaccaattctccagttaaatggaaccaaagcgcggtatcgctgatcgctacgcttccacgccatggcccttcttgctcacagacttcgaaccacaagctaatttccatcctggccaggactcggccgaaggattcgagccgacgccggctggccaggatgtcgacattcacccgtcgattaatttcgtaccggcgaccgttgatgacgaagaccaggcgcagggtgcgtccgtccagacattcccagtatttggtttcataccgaagccagtagcgcttgccagccgggcctaccatggtcatttaatcgatgctcctggccgcgccacgcggtccggtcggcgggacgggatcgaaccgacccaggatgtagtcgggccggcgcgcttcctgaggacacacggcgagaaggcgccatcctgcgtccagggcagactggagttcgtccgtgcagcagtcttccttgagcagcagacggttgacgttctggagattcggaccaggtatggccgatcctgtgagtgagttccaaccttcgacgccgtgcaccatctgcggttggttgatgtagccttcggacctgccagccaaccggcttgcggccagctccaggcgctccagcatgggtcgcagagcggcttccgggtcaacgtcgtcccagagaaggaccaggttgatgatggtgtacggatagtccttgtccagatcccaggccgaagcggtcaggcggcccaggccgatttcattacacataacgggaacgtcgttgctccaggtggacggctcccagttccgctcaccaggattcccgattgttacgccttccaggttccccaggagaacgtggagcttgctgacatattccgcctccaaggctttccgctcttcgtcggtctggttgtggcgatagaaggatggagggctgactttggcatggtagagtttcatgattgttcctttatgtagggttcaacttcaaagaatttcgtcgcagaacttctcgaaaggactccgccttttcttctcgcaggcggcacaggtgatttccagggccggaatctcgttataggtcttgccgaagtacagccagcgtttacataggcttcgaccgtccgccatgaagaagtgagcttttcgagcagcgccgggttgcgcccagccgctcggcatcttactggacttgttcatgcggtctccctcttcggctcaggaatccatggtgtgatttcgtccgcccattccccatcgatgaacatcaaggacagaagaccatagcgcccgaagctgaagcctacatagaacgatccgggttccacttccatgctggcggtattgcgttcttcgatcatctggaaatcgaacattgcatagctcataccatcaccatgtcgatttcattgatgaagaaatggacatcgacaccatcggcgcggccggtgtaacgcagccgagtcgtcccatcaatgtgggcttcctcgacgccgatgacttccaggatggtgtcgttgcaatacagcttgacgaacatcttgatgccggagccaatcgcctcgaaggcaatctgcttgtacaggtcttgcttgatcatgctttacgctcctgtttgcggatgtattctgccctgacttcggcttcgaatttcgcccaaagcgcgttgtcgactggaccccagggaccggtctgagttccgtccaccggtgcgaacttgccaccggcgcggcgatatttggacagagttttcaggctgatgatcttctcatcttgggaatcgaattggactatcatttgacgtacttcccgaagtagcaggtgtggaggatttccaggcctttggagatagccttcagcttgatgccgaaattcttgatcgcccagtccagatcgtggtgatagaactcgatgatgttgacgatttgaccggcgctgtagtggatgacgcgaaccttgccgttccagcggaaatcttcgcggctgtttacggcctcgacttcgatggtgtcgtttctgccgatggtccatttggagctagtcatgtcgcaatcctctttttggagtgtttcgcgtttcgatgaggannnnnnnn

SEQ ID NO: 2 - DNA, 45582 bp, artificial sequence
  BP1429
atattccccagatacaccggaggataaaatagacttttggggtatccccggttataggccctggatcaaaggcaacccccgatacctgttggtatattactgggtaaaggggcaatagaccaggacatagacaacagaggtagtctaggggtatacctatggaacaacctcagggagtacctatagaacctggatcaagggaaccctatgccacttaccccttaccagcaacctacgaagggtagtcttagggtatatctatagaaccctatcataccgttcgtcgggtaaatcatgtgattatcaaagaaatatcaaaaagtacttgacaaggtatcgaaaatgtagtataatagacctataggctcttaagattccttcttccttttgacttacttactaagaaggttagttaccttaaggttatcttaagatagtcttaagaacccctttcccattccagcaaaacccctaacaaatccgggtcttgcgactaaaaataaaaaagatgaaaaagacttgacaaaatagaaaaagtgtgatataatagtattataaggttgagaaattaccttaagaattaattgggatgtagctcagttggtagagcagggagctgttaactctcaggtcgtaggttcgagccctgccgtcccagccaacagaggtcgttgtagaggtagatggctactaccatccggctgtaacccggacgccattggctagaggttcaattccttccttcgaccaccattaactcctcgtagctcagttggttagagtgcctgtcttggacacaggaggtcgtaggttcgagtcctaccggggtgaccatttagagagatcggagcagtgtatgtcagacgaaaaggttgtctcgattggggctgctcctctttctgctaaagaaaagctagacctctattgtgaggctctggcggatggtatgaataagacccaagcatatatagccgctgggttctctcctaatcatgcgcaacgcaacgtagctgcataccatcgaaagcatgccgagtatatcaacgcctttatctctgagcgcatcgggagtcatgtccccatggcgcttcgtgtggttgtagagatcgctagcaacccagaagagaaaggtgggattcgcctcaaggcggcccaggatatcctggatcgtggaggcttcggagctaagcagaaactggagcttactactaagaatgtggaagatatgtccgcagaggatctaatcagtgaagttcgacgaattctcgacgaagagccagagttggctaaagtcatttctttcccaacctcttaagtaccttgatctaatcaagcgaagagaggggttggtactaaagtggtacaaagactccctcgggaaagtaactggtggttatggccacttgcaactccctggggaagacggaccgattaccctagcacgagcagagacttggctagagaaggatagtaaggcagcctatgatgcagcccaagggcaagtatctcagctgcctttttgcactccagagctattcgatgccctcgttagcgtcaacttccagctgggtacagcgtggacgaagaagttccccaagacgtggaatcttctgaaatccggaaggtttgatgaagctgcatgggaggcagaggatagcctctgggccaaacaaactccggtacgcgtaagggacttccaacgagccctgtggcgtgcatcaacagtaggtgacaaggtggtctaatggatacccaagagcggctacggaatctagtcagggagttggctgagcggcagaaatacttccgcatgaaccagtacactccttatgggtggcaagagaagtttatcgcagcttcctcgaactgcgcccagctactggctatgactggtaaccgctgtggtaaaacctacaccggggcctttatcatggcctgccacctaaccggtcgctaccctgagtggtggactggtagaaagtatgatcgtccagtgaactgctgggcggcggggatctcaacggataccactcgggatattcttcagtccgaactcctaggggactggaagaaccctgaggcttttggaacggggatgatccccaaggaagatatcgtagagacgattcgtagggaaggtaaacccggatgtgtgcaagcagtagttgttaagcatgcctccgggggcctctcgtcccttatcttcaagtcctacgaaatgtcccaggacaaattcatgggtactgccatcgacgtcatctggctcgatgaggaatgccccaaggacatttatacccagtgtgtaacccggacggctactactggaggtattgtctatctaacctttaccccagagcatggcctcacggaaatcgtgaaggacttcctccaggatcttaaacctggtcagttcctgatccatgcaagctgggaagatgccccacacctcagtccagaagttaaagagcagctactctcggtatactctccagcagaacgcaggatgagggccgagggtgttcctatgctcggatctggtgtagtcttccccattctggaagagaagtttgtatgtgagcctttccagatccctgaccacttccataggatcatcggtatcgacctcgggtttgaccaccctaacgctatcgcctgtgttgcttgggatcctgagaaagacaagtattacctctatgatgagaggagtgagagtggtgagacccttgggatgcacgctgatgctatctacttgaagggtggtcaccagatcccggtagttgtcccccacgatgcctttaagcacgatggagcaacctctggtcgtagattcgtagaccttcttaaagatgaccacaacctcaatgtagtgtatgaacccttcagtaacccaccgggtcctgatggtaaacacgggggtaactctgtagagttcggcgttaactggatgttgacccgtatggagaatggtgatctgaaggtgtttaatacgtgtacgaacttcctaaaagaaatgaaaatgtaccaccgaaaggacggaaagattatcgacagaaacgacgatatgatctccgctacccggtatgccctgttgatggcttcccggcatgcacgtcctggtgctgtacgaaacagtggatactacaggagtgatactgcaaagttgacccctgattggtttgggagtattgtctaatggctaagcgtcgtcgcaagattaagcctatggatgatgaacaggtacttcgtcatctagaccaacttgttaacgacgcccttgatttcaactcttcggaactttccaagcagcgttctgaggccctgaagtattacttcggagagcccttcggtaacgagcgccctgggaagtccgcgattgtatctagggacgttcaagagactgtagactggattatgccttctcttatgaaggtattcacgtcgggcggtcaagtagttaagtatgagcctcagactgccgaggatgttgaacaggcagagcaagagaccgagtatgtgaactacctcttcatgcgtaagaatgaggggttcaaggtgatgttcgactggttccaagacaccctgatgatgaagactggcgttgtcaaagtctacgtcgaagaggttcttaaccctaccttcgaacgattctctggtctctctgaggaaatggtagcggatatcctggctgatccagacactgagattctagcacagagtgtggacgaggatggaacctacagtattaaaattcgcaaggacaagaagaagcgagagattaaagtcacctgtatcaagcctgagaacttcctggttgatcggttggctacctgcattgatgatgcacgcttcctctgtcaccgtgagaagtataccgtaagtgacctgcggctcttgggtgttcccgaggatgtactagatgagcttccatacgatgagtatgaattctctgatagtcagccagaaaggttggtacgtgataacttcgatatgactggccaactccagtacaactctggggatgatgctgaagccaaccgtgaggtatgggcctctgagtgctacacccttctggacgtagatggggatggtatctctgagttgcgccgtatcctgtacgtgggcgactacatcatcagcaacgagccttgggattgccgtcccttcgctgacctgaatgcctatcgaattgcccataagttccacgggatgagtgtctacgataagatccgagacattcaagagatccgttcggtgctcatgcgcaacatcatggacaacatctaccggactaaccaagggcgctctgtagtcctggatggtcaggttaacctcgaagacttgctgaccaacgaggcagcgggtatcgttcgggttaaggccatgaactctatcatgcctctggagacccctcagctgtctggggaagtctatgggatgctggatcgactagaggcagacagaggtaagcggacaggtatcactgaccgtacacgaggtctagaccaaaacaccctgcactctaaccaagcggctatgagtgtaaaccagttgatgactgcggctgagcaacagattgacctgattgcccggatgtttgcagagactggtgttaagcgtttgttccaacttctgcatgaccatgccatcaagtaccagaatcaggaagaggtcttccagctacgaggcaagtgggttgctattaaccctgccaactggcgagagagatccgacctgacggttaccgttggtatcggcaacatgaacaaagaccagcagatgctccaccttatgcgtatctgggaaatggcccaggctgtagtagggggtggaggtctcggggtccttgtctctgagcagaacctttacaatatccttaaggaagtcacagagaacgctgggtataaagacccggatcgcttctggactaacccggattctcctgaagctcaacgggctaaggccattagagagcagaaggaagcacaacctaagcctgaagatatcaaagcccaagctgatgcccaacgtgcccaatcggacgccttggctaagcaagcggaggcccagatgaagcaggtagaggctcagatccgactggctgagatcgaactgaagaagcaagaggctgtccttcagcagagagaaatggcccttaaggaagcggaactacaacttgagcgtgatcgtttcacttgggaacgggctcgtaacgaagcggagtatcatcttgaggctactcaggctcgggctgcttatatcggagacggtaaggtacctgagactaagaagccatctaaggcagtgaggaattaatcttgggagaacgttttggctatagtctagtgctgactgatgcggcacaacagatggtacgtgagaacgttcttcctgagcttttccgtattgtccaagaagagatcgagggagagtggaagtccacggcacctaaggattcagaatccagggaagccatctaccacgaactacatgccctcaaccgcgtacaacttcgtattcaggctatcctggattcgatcactctaaaggagtataagtaatggaccttgagaatcaaggcatggatgaattcgaggcagcggaagccttcggagatttgctaggtgatgacctcctggcccccggtgatgaaaccgtggatggtaaggtcgtaggggaagaagaggaggaagaggtagtagacgaaggtactccagaggacaccgaagagattgagtccgatgaggtagaagagggtgctgaggaagaatctgaggttgagtccgaggaagatcctgaggataaactcttcgagatcccgattggggatgaagtctacgaggttaacttcgaggaactcaaaagtggctaccttcggaatgaagagtttgtaactcgacaagctgaactagaggatcagtatgcagctagattcgaagagcttgatgctgaacgctctaatctactggccgagcttgagcagtatgctgttaccgctatcgctggtgctaatcagtatgacaatgtaaactgggagcagcttaaggcccaggatccagagaagtatcaaacccttcgactggaagccctggaagcccgagaccgagcccaggctcttatcaaacgtcgtaacgacattaaggctatgcaagagaagcgagccgagattgtccactctgcctacgttaagcgtcagacagagctagccaagaaacttatcccggaaatgaccacggatgagtcttggggtgacaagattgtgtcctacggcaaatcgattggatactccgaggatgagatccgagggatatctgatgcccgccaactggctgtactcgatgcagcacgtaagtgggctgaatctcaggtccgtcgcaaggctgccctagagaagaaggaggagactgaactacctgctgctgttaagcctgtagctcgtagggcggaagcctcagagggttctaagcgggttaaagctgcccgcgctaatctgaggaaagatcagtcggttgaagccgctgctgctctcttctcctctctcgatattttctaatagaaggaaacgtaacttatggcaactccaactaatgccgtctcgactgtagagatcaacggtaagcgcgaagaccttatcgatatcatctacaacatcgcaccctatgacaccccgttcatgactgctatcggcaagggcgtagctaccgctatcacccacgagtggcagactgatgaactccgccagccgggtaagaacacccgagttgaaggtgaggatgcaaccatcaaggctggtagcttcaccaccatgttgaacaactactgccaaatctcggacgagaccctgcaagtcaccggtaccgcagataaggtcaagaaggctggtcgtaagaacgaactggcgtatcagctggctaagaagtcgaaggaactgaagctggacatggaatacgccatggtcggtgcccctcaggctaagatccagcgtaacaccactactccgggtcagatggcaaacatctttgcctactacaagaccaacggttcggtaggtgctaacggtaccctgccaactggtgatggttccgacactggtaccactggtgatctccgtcttctgaccgaagatatgctcctgaatgcctctgaggctatctggcgcaacggtggtcaggctaactcgatccagacttcgagctcgatcaagaaggccatcagcaagaacatgaagggtcgtgcaactgagatcaccctggatgcctcggacaaccgcattgcgcagaccgtggatgtctacgagagtgacttcggtaagtacaccattcgtgccaaccgctggttccacgaaaacaccatgttcatctttgatccgaagatgcacgccctctgctacctgcgtccgttcttccagcacgaactggctaagaccggtgacagcgagaagcgccaactgctggttgaatacaccctgcgtgtaaacaacgagaagtccggtgccctgatccgcgacgttgtagcccaggtctaacccaacggggcccttcggggccctttgtttccccttaggaggtacatcatgagtatccaatcgacttatgcaattgacgaagaccttgggctctttatccgaaaggatactcaagatgttgagtcaatcctgtccgctaacgcagaagagcgccactcgggtgtcaacagtaaccgaaaggataatatgcgcaaggtagcaagtatccccctggttgttgtagaggccctacggaatcgccccatgtctgaaggtggtcccatcgatcttaacctgatcggttgtgacccagaccatgccgctcgatttacccgttggcttaacgaccgagacaactatcgtatgcggacctctgaggcacgggtgtaatgaatggctacgatcaacaacgtaactgatctcgctatcgccgctatccagtggtctgaccgtcaggatcttacccaagaacttctgatgttgttcattggtaacactactgaccgtcttaaccgattgctacgggtgagggagaacgaacacttcgaaaccctaatggccttcggtggtggcattgagatacctgagcactttgttgctctacgatctatcacgggtgactcccttatcggtggacgtactcttcagtacatcacccaggataccttcacccattatgttaactacaactaccaacctcagggtgtaacctactacactcggttgggtaacttctggcgagtattccccgttgttcctgacggtgccccgttcattgtgaactactggactgtactcccagagctaagcctcgctaacccaacgacttgggctctgacgaagtatccgcagatttatctctatggtgtccttgagcagatttatctgtacaccatggatgaagctcggtcccagttctggggtcagaaactcgaacgggctgttatggaactccagaacgaggagaatgccgctgacttcgctagcactcgactggcgatcaaagacattgaacgttaaggagattcagatgcctatctttctaaaaaccctcgcaatcaaccttctggctaccctcttcccaaccaaggtaatcgctaagtccatcgtgactggtgctaaggctctggcggagaagactaactctaaggttgacgacgagttcgtaaaagtcctggaagacaaccttaaggagaagacggaggatgcaacttctaactgataacctgggcagcatcgtcagtgccctggtcgtatcctcggtagtgacggtaggttcctcggttgtcggtcagaatgttaatcaggctctgcttgaaagaaacatccaggccacggagaagctcacccaagcggtgagcgatctccagatttctatggcaatctttggggagcggtatgtcacccgaaaagaaatgaaagaagagataaaggaggccaagaatgggtcttgaggtcgcaacttacattaaccagttggtgcctacgaaccctaccggctctgatctgaaatcctttggggatgaccacctgcgtctcattaagagtgctattaagaacaccttccccaatatttctcaggctgtcactgtaacggcagcccagctaaacgcagtcgctgatacaacccagtatgttaaacctgggatggttatcatgtgggctgggtcactagctcagatcccagcaggttggaagttgtgcaatggggtaggtactacctctaatgggattcccgtccctaacctgattggtgcattcccttggggtatcgatggttcttcccaggctgtaggtactagaggtggtagcgctaacatcgtatgggatgggttcactgaagggactgcccttaccctagcccaaatcccatcgcacacccacacttggagatcccgaggggctactaccctcaccggttctgcgggtgactctggtgctctgacgggtggctctggtaacgcagccaataccaaccttgagactggccctgctggtcaaggtcagactcacaaccatgcagtaaagatcaacatgccgttgggtaatatcccaccgttctgttctgtgttcttcatcattaagaactgaggtatacaatggccctagagagacaagaggtcaagaaccctacggggattgtgaccgatatcgcccccgctgacctgccactggagaaatggtccttcggaaacaacgtccggtttaagaacggcaaggctcagaaggctctgggccatacgcctatctttgatacagcccaggccccaatcttggatatgttccctttcatccggaataacatcccttattggctcctgtgttctgaacaaaggttgtatctagccgacgggactacaatcatcgatgtatccccaggaccttacgctgctagtataactaacaggtggtctgtaggatcgttcaatggggtaatctttgctaacgatggggttaaccctcctcatcatcttccaccgtcagaatcaacctttagggtactccctaacttcccagcgaatactacttttaagaggcttaagtcttttaagaacttcctggttggcttaaacgctacaagtaactctgtagaaatgccacagatggtctggtggagtacctcggctgatgctggtggtgtacctgcatcttgggacccaacggaccctactaaggatgctggtcagaacaccttggctgataccaatggtgctatcgtggatggtgtgaagcttcgtgactccttcatcatctacaaggaagactctgtatactccatgcggtatatcggtggattattcatcttccaattccagcagctgtttaacgacgtaggtatcctcggacccaactgtgcaatagagttcgatggtaaccactttgtagtaggccacggtgacgtatatgtccacaacggtgtgcagaagcagtctgttattgattctcaggtccgtaagttcttcttctcggatattaaccctgacaactatcaacggaccttcgtaattgcagaccacgtgaatactgaaatgtgggtatgctactcttccactaggtctgagccaggtaagcattgcgatagggctatcatctggaactggaaggagaacacttggagtatccgagaccttcccaacgttctcagtggagcctacgggatcatcgatcctaaggtgtctaacctctgggatgacgaccccaacccctgggataccgatacttcggcctggggtgaaggttcttataacccagcaaagcccagtatgatcttctcgtctttccaggataagaagttgttcctcttcggtaataactctacattctctgggcagaacttcgtcagtacccttgagagatccgatatctatctcggggatgatcgaatgatgaagacagtgagtgccatcattccacacattactggtaacggtacttgtaacatctgggtgggtaacgctcaggtacaaggttctggtattcgatggaaaggcccttacccataccggattggtcaggactataagattgacactaaacatgtgggccggtatatagccttgaagttcgacttctcttcggagggtgattggtacttcaatggatacactattgaaatggccccgaaggcaggtatgcgatgagtcaaaagtacagcccttcgattccaccacaggaagaggaggaactgctgcccttccttaatgaagaattcgttagggttggacagactcttaatgacctagctgacggctactggggggtctctatggagccccctaagaagctcaagccagggactgtaaagtattttgcccccggagtggtaggtccagtatccggcatctatcattacgacttggataaccaatggagactcgcaggtactaaacccaaggacctgccgggggattttatcctatttaccccacagaacaaccatcagccgatgggtacctgtgcctataggatgaacactgctaaggatgaagtgtggataaccatgctcatgtctggtggtaactacactaatggagctactgtcctggatcttccccaggcgtattggcctcctgctgagttgtttatcccggcttattccagcatcatcccagcgcagagcactattacttatccacctccgtctgaccctaacgcacctccgttggatcaagtctttgatgttctcaacagggctactattcagactggtgtggttaaccaagcaatgtttaagatcacagctaatggccgtgttctaatccaaggaattccccaaggagcagtcttcgggggtacattcacattccccctggtggtgactccatgattcatttgattactcgtgagaatatagactccctcccgaccgtagttccagccctagcccgtgcttttaacaggactgacttgggtaagttctgggactttgagcacttggtgcattccctggttaattatgaggcctatgtcttctaccaggaagagagtgggtacgcgggagtcatccaagtatcccaggcccccttgggcaacatcctacacttcttctggagtggaaagatgcctgggaatgaaaccccggtagattactcggaggtagacgacttcctcggacagttcgcccaacgagttaactgtcggtttatccaatgcgaaggtcgtcggggctggaagcctaccctagagaaactcgggtacaccgaagactccgtatccttctatcgtgaggtaactccagatgaacttcctccaatttaacgtaaaacgcctgatggggtttggtgtagaggatgctctagattctcgggcttacaagggtggtagtaagaagcaaaagaccacctcagtgtccacaccctatcagcaaggtaactataatgaactactctcgggtgccagtgattggctacataacgggggctttgaccccaattacgggggcgatccgaactttgacccggtggctgaccaaaatgctctccagcttagtggaatcgaagggctgggtggtctcgggggtgcccttcagtctctcctgggtagctcaggtgttagctctctggctgattaccttggtccttacgatcccaacaaaactggcttggcgaacgccattggtgcagccaacgagcagatgcaatgggacttcgacactacggtacgtccagacctgcgagcaggggccactaatgctggtcagtatgggagttcccgagcgggtgtagcagaaggtattgctaccgctagattgctccagaatcaacagaataacgcctcccagttggctttccaagaccagcaggcttacaaccagaaccggttgaataccctgggtaacctgtcggctattgctaagggcctaggctctggtaatgccatgcaggttgatgctggtagtatgcttcaggatcaggagcagcaggagatcaacggggctctacagaagtgggcctatgagaataacgtcagccttaacgacctactcgcctacaaggagcttatctccggcgacatgggtggaaccaacgttactacctcctcgggtggtggcggtggtggtggcctcgggtctgccctgggtgctctcggtggtgcttccttgggtgctctcttcggtggcccagcgggtgcttctgttggtatgaatgctggtggtagggtcgggggccttctgttctaatggcctcccttcctcagaagctgttcgctataggacagaatataggtggtgggcaggagcgggtacaattgagccgtcaaggttcctaccgccccacccaccttgggacaatgcaatcgggagagtctagtggacaatcaaacccttttggcgcaatgggcggagcagcactcgcggctctcctcgggaaaggaagtgagccttcttcagaaacagtaccaagcttttctgtcgagggggctagaggagcaagcgaacgaggcgcagcggaagttgcagcaggtatgggagcgggagtgggaatccttcctagcgcagaagaactcggtttcggacagcagccaaagtctggaatcctaagtaaactatttggaggttaatcctatggccagcatggcttatgaagggtccccaattcgccctagcatccttcgggctgctcagaatgaactggatatggcgcgaatcgcaaggaacaaactgccgctggctgtagagggctcaggtattcctgatcgtgtccgtcgtgctgctcaggcagccctggagaacccagagcgttggtcccgtgcagcccaagaggttgcacctgcggctgaagctactggtcgcggtgccttgggtcgtatcgcaggtatcctcggtggtcctatctctgtaggtgtacaagccgctgtaaccccaggagaactcggggatgcagagcgtactcgtgcagaagaaatggctcaggctagccaagcggttgagaacatgggtcccgaggttgctcaagaggctaaccaatgggcccagggtgtaggccaacgtgcagcccagaactccacaggaggccctacgggggccggtctgttgtcctatggggtaacccctaaccaaccctctatcgagcctgagatcaccccagaggtggcttcagaggctggtgctgctgtagcagatgaggaggaggctaatcgacaggtcatccaacagggtgcagccgagggtcttcgtactggtgctgtaagtcgtcctgaaatggcccaagctgtagttgaggctgatgcccagcgagaaggtgtagagcttaaaccccaagagcttaagaaccgggtgaacgaagagttgacccagatgaggactatggataatgatgacctgtctcgttatgtatcttacgctctcattggtactggtcttctggcttcggccctagacaagactggtaaagccggggatatgttcgctgcttcctatgagcgtcaactggatcgtaacctacaggctgggatcaaccagcagaagatggctgccgcagctgctgatcgtcagatcaaggaaaaggatctggaacgtaaggtggctaaggatgctgctgatgtacgtctaggcgaagggaacctggaggtcaagaagggaacccttaaggaaacctctcgtaagaacactggtcttctgggtaggtggactgaggaggctgctcgggggagagccaaccttgccctaacccagcgtggacaggatctggctaatcaacgggcccagctacaggctgaaacaacccgtcgtggccaggatatgtctcaagagaatgcccagcttagttctgctgtacgtctgaagactgctaagatcagcgctcaggcacgtcaagcggcagctaaggcagcccgaggtgaagctgttactactaaggacgcccttggtatcctgagtgaagtcaatggttctcaggctctgggtggtaagaagctgagtaagactgcccaacaggctattgcccagactgttcgaaatgaacttcgggctaatccgggggctaaccctgtgggtattatccagcgggaggctgctaagcttcaacctacgggtaactggtttggtgctgatctggactatcctgccccaacccgataaaaggtacttgacaaagtatccaaaatgtagtataatagacctataggctcttaagattccttctttctttgacttacttactaagaaggttagtatcctaagatacatcttaagagcctattctctttccagcaactagaaggtgacttatggctctttctccagaactgaaggccgctattgatgcggaactggctgaggtcaagggcctcgacgtagccgctgaattggcttccttgaatgagccagaggttatcgaagaggcaccccaggaagtagctccagctacccctgagcctgccccagacctgagtgccctagtaactccggctgaccctaattctattagctctgcgattggtcgcggggttgataccatgcagtctaacatcggtggcaccattgctaccctcggtgaattgactggcagtgactacctgaaagactacggcacacagatggccgaagagaattctcaggaagcgtcacagtacggaacccctgatgttcggtctttcgctgatatccaagatatcccatccatcggttcgttcctcaagaataacatcgtagaggcactcccttcgatggcccctgtacttgctggtggtgccgcaggtgctaaggctggctctgtctttggggccccaggtcgtatgggtggagcgctcattggttccttcctgagttccatgggtatcaacgtaggtgccctgagtaaccagatgaaggaactagaccccgatcaaagcaacccatggaccgcagtcctcggtggtgctggcctctcggtactagacactgcgggtgctggtgttatcgctgccccactcctcaagcacatcggtaaagatggcgcttaccagatgttggtccaatcgggactacctaagcaaactgctatcgaggctgttacccaggctggtaagcatgcagcagtctctggtgtagccgagggtgtaacctctggtgctcaacaggcgctccaggataccattgcctatgatgcagtagggcagacccaaacccctgagcagttcatggataacctcctgacggctgccttcactggtacagctatgggtactgccggtggtgctgtatcctctggattggacaccctgggacgtaatcaggactcagccgggtctgccgtagttgatcctaacgcccctgcggcccctcctaaggcttctgagcttgagcctaggggtacggtcaagaaagcctgggatgccctaggaaacgaagctacgtccctcctggagccacttgctaaggcttctcctatcgcccgtgagttctctgagaccttcagggcagacatgagtggtaagcgagcctctggtaagactatctttgaggatcaggaactccaggcaggtaagtggaactctgaactcgataacatcttcgagggtaagtcttcgaaagagatcgacaggattatctcagatacatccgcaggtgtcaataccccagaagctacccgtctccgtgctttgatggatgacgtaaggaatgaggctgttaaccgtggtggaatgtccgttggtactatccccaactatatgccctttgggctgtcccctgagaaggttcaatccccagagttcctgaacgatatcactccgtacttccagagccgacaagctgctgaagatgctgtagccaactggctggcagaagtctcggatgatactcgtggtaacactgcccctgaggttaaccgattggttactcagaatcagcagaccggggcttgggaagtagacccacgctaccgtatccagggtgatccagatactttacgtggacggtttgcccagagtgatgcagtacctaagtatggtcaactggaagaaagccgggcctttggctccgtacctcaggagatcctcaacaagtattccctgaacgatactcctaagaagcgtctccaggaaatccgggactacttcgaaggggcttcccaccggattgcctttaccgaacggtttggtatcaacggggagaaggctaacgctaagattgcatctgctgtagctgaggctcaacgggctggtaagcgggttactaaggaagaggtggatcggatgtatgacctagtggatgcctacaatggtatgcacggtcgtatcaaagaccctaaccttaagaagctagcggctgttacgtcgggtgccctcgtgctatcaagacttccactcgccggtttctcgaccctgaccgagttcagcctacccttcgctaaggcgggggttatgcctacccttggggctgtactcccaactatgggtgaagtagtaagacaagcagcccgcaggatctacagtggggttccaaagtctgagaccggtcggtttatgagtgatatgaaccacaccctggcttctgctacttctctgatggctgatcgggttggtgctgaggtgtttaactctaccatccaaaaggcgatccgtggtcagttcctcatcaacggcttgtccatcctaacccatgttaaccgaatatttgcaacagagactgctaagcgggtctatcagaacaacctgatggatctagccgcaggtctccctttcagttctgccaatggtgctctgaaggttgctcagcttcgggaaatgggggttaacatcggtagccagcaggatgccctcaagttgatctccccggctactccatctgaagtcctgatggctaacaacgtcaagactttggccatgcgtcggtttgtagatcaggtagtcctcgaccccaccttcgctgataagcctatgtggatgagcaacggaaacgttcagatgttctccctcttgaagggttacccagcagcctatggtaacatcatcctaccgatgttccgtagacgaatgagcccacacttctctggttcttggaccaacgctggtatgggtgccgcaggtgtagccttcactcttggtctgatgatgagtctggggtatctccaggatgagcttcgtcaactggctaagttcggtgggtctagccgagaggatacccgtagtccagaacaacggatgatggacgtagtgatgcaacagatgccactccaggcttctatgatctacgacatgctgacgggttaccgtcgagggactacccccgcagaggtagtcttgggtccagtagctggtgctgcaactgagggtgctatggctgttggtaaaactatcgcttcgtttggggatgacccatccgcaggtgaaatctggaagttcttgtataagcaaactccagcacgtcctttcgttgccggtatggaagcgatggaagatgctctggatctttaaggagaagtaatatggcaacttatgtagaaactgatgccgctggtcctggtggccgtgcctacgtggttgatgtgccaaaagtcttccgacgtaattccgatggtgatctcattgagattacctcggatgccggtcgggtgaatactaacatcgttaccgctacagagttcctccctgactattatgcagttaaggagaacgcagccctggtagtagagaacgttacagcctccttcccggagaacccctcagaggccgttatcccctctgtcctggtcaacaccctcgtgggtgctcctggggaaacctcgggtggtaaccgtgaccctggccacgtgattggtctgttctctgagaccatgattgaggcaccttgcggtactgcattcggtagtgaattccgggtagaccctcgccgggaacacctgggtgtttacgtggctatcaagcacgtgattggtccagatgaccaaaacggtggtaccatcggtgactacattatcgagcagtttgacgacatgcgtggtcctgtgaagaacattggttctctccaacagaactaccttgacccccgccttgtgactactcacctgggtggtaacgtcgtcaatacccagcagcttactcagaatattaccctgactaagcaacaatctggatggttcttcatgtctcaggggaccacggatattaccgtcacccttggcccggatgtaaccccaggttgtcagttccactttatccagggatcggcagctaagatcaagtttgctgtatctccggacaaggcttggtatgctaagggtaatcagacggagactgatggtcaatttggggaatgcactgtccgagtgtatcctttcggtggtaccgtgggtaccttcaaatcggcagtttaattaggagttagattatggcaggttatatcgctgacaacgacggcaacagtgtattcgttattcaatcgaaggctattgctgtacgtaatgaagatgggacccttcgacaagtcattggcccgaaagactttgagccagtgaaatgggaggatattgaggggaagcctgagcttctggaggtaggtgctaaggctagcgaggctaaaccaggtaactggaaacccaaggctagcgaagtgagtggcctagatgcagccattgcggcttacgtcaagggtaaggtagttgagatccccgtggcttcctatacggatactcacgaggcactcgttgataagttcaacacactgctgaacgctctacggagctaaagataaggccccttgggatgatacccttggggcctttttttttggttactcgatggatacctacagtgaacctgcccaagataatacatcgatgaggagtctggatatttctcccagggtcaggagtaacatcagtcagctatatcctacataaaccagcagggcaaacaaggctgctaccgcaatgtaggtccaagggaatccacccttacccttttgatctttctgcataacccctccaatctccgtagaatacagaagccctaaggtctactaggtctagcatcccttcgaggaattcaatctgtcttttagcttcttcagccagttcttcaaaggaaaaggccttcgcctcagccttcgcaagagcgctttgcgtctcttcaagtgctttctccagttcagcctttgtcatagtacaccaccttgtcactgcttcttagaacatactcagcgtcaatagtccaactcatggtcgggcatttgatccgaatcatcttgggggtaaacccatcgacggttccaatggctagatgggaggaggtgttcctgtggaccaggaaggctacactgtcccctacctctagcttacgtcccactcgatctttcatagattaccccaagatatccggaaggtgaacgctggggatgtagaggatctccaggacttcgatggaatacatccctcgcctaagcccctcctcagcaccccctttcccaaacttcatatccagccagagttctgcggagatcggcgtcttaaacgccaacccccgttgaccgaagtcatgctcagacttaatgtagtacaggtctggcaagaacttactcacaggaactcctccacactcatcagcttgaggtcatactctccgtccttgtggttccggaggagggctacacctcgccagtggtcgttaccctggggccctttgtaggactcatcgtgagtgtagaagctaccgactacaagcccgtggattcgcttcttgcctactgcctcgatgtggtacttgaatccctgttcgtggccttggacgaagctgcgcttgatcttattgaggcgatgctcggcactcccgccgtatggccgaccactgttgggattgtagaagtagtgggcgaaggcgacaccttcgataacacccacgtcgaggaaatcatggacaatccaatcggacagatcaaaatgatcgtacccaataaaaccttggagagcagggttagaattttcataccgcttgatacgctcctcgtggtttccgatgaagaagtgcatttctggtcggtagatacgcttcttacaacccgcttggtgttgctgtaggcggcgaagaggatcgagcagaactcgcatcgcatcattaccagcttgtatgtcagcgaggactcggcggccttcgatcttagcggtaccacggtcgtagcttgacagactgggcatgtcccaatggtccccaatatgaacaattcgcttggggcggttacgtgcgatccactccccaaggttcccgaggtgatcgatgttgacctcggatcgaacttgggtgtccgcgataacgagagtgtcttcattatacttcttactcattagggaaggactccttgaaagtctctagagtaaaccagcggaatccgttacgttcggcccattccgccatagtttgctttgtgccatcctttcgcttactaagccaatggcaagccgtattaggccgctcaaagatgaacacaagttcagtatccgggggaagggcctccctcacccagatatacttggatgcctcagacgcctcttggaagtaccccttgacctcgaccaacaggtgcttcgtcgatccacagggttgcgaggtcgataccttgaagtctggcttgtacttgtgctgtatgacgtatggtaccggggacggtttgaactgcatccaaggcatcgtctcgtggacgatcttctcggtttcgctgtcgtacttcgtcccaatcaatgacttcagtttcggtctgaagaacctgccctgctttgccaattagaccctcctcttgaagccttactataaagtccattgcgccccctgcgtagactgaacgtgaacgcagaagcatccaaatccagtccccaatgcacactcggtggcctgggtacttagccttcaccctctttacgtggttaacgagcttctcgatctggccaacggtgaccgcgtttccactctccagcaacggatcaaccatacgattgatggtgatgcacttattctccttgtcccactcatatgccctggaccggtagatttctccactaaggtcacgacgaagggtaccagtaggccaacaggagatttcacagatccccatgtcgaactctgctgggtgactgtcagtggatacgaccaggttcaccggaagatcaataccaatggactcccacacagaaaacccttctggatacccattgcgtagttccccggacccagtacgaaccttcttgtgacccagcttgttgtagaatcggatgacttctacctctagggcatcatcatcacaagggaccatctgaggcccaaagacacgtgagactcgtctacgtgggtcttctacacgaggcctgcgtacatacaggtcgatatccttgggtgctaccccgttgtctgcatcccggaggaaaccaccagccaccttgtagtcggtgaagccagtagtctccaggattttgaagagaccctcacagatagacagggcctcatcaatagaataaatcttcgtcgtcataggggatctcccaatgtttcttcagtgagcagtgatactcgttaccggactgctgaatatcaagccaagagcggtcgcgaatgaggtagaggagacgaaagttttccacaaggtactccttccaattatctccgtacttctgttggtaggcgtaagcgcaagctgcgaagagatccctctcagtagaaagctccccaagcaaatctgccgctgtctttggtcccgtccctgggaggcctggtatgttatccacggagtcaccaacaaggagttgcccgtagaggaatgccgtaccgttgccctcaagtttccatgacttctgcggtttcttaacaccatacattcgccaagaagcggagactgttccaaggccatcgacttgaaatggtcccaactccggctgggaatctccacagggccaactgtaatggtagcatcctgggacttggcggatatccttgtctctagaacacgctgtaaagttatctccctcttcagtgcctcgaatcccgagccagtcatcagcctcgataccgtggaaagtgattgctccccacttgtccttaagtctggctgacacggttttccagtgatgaggcttttcaagaccgattcgagtacccttatattgcttgattttcgcaagctccagcctaaaatttccttggccagtaaggtagatttcacactcatctgcatttacccttttgataatttgttcgactttatcatcgacgagcttatggacctcttcctcaggccatggcttctccacctggatatcgaagatgtgttccttcgacatagccacgtggcctagctcatacctaagaacgtcaccatcgataccagctatcatcacgatacctcttctacgacctgggattctttgagcttctcttcccagaagacacggagggcaaaggcttcacccttggctcggtactctgggtgctctaccactggattggccagtgcttcataccccttccagtcgtaatactcgctctcttgacgcttggctttgtccatagcttcctccgttaggctgtagcctgggggaagccccaggtctacatcgacgccaatcacagagtagttgctaggaacagtcttagcccttgggtccaacagaagttccattggattcctcctcttgctgaatgacgagttccagggacgctagggcgttccacacttcgtgataccggtggggtagattactttgggggtccaaagcttcacccttgtgtcgctcaaggaggtgtctaccgaaggcagcatcatatcgctggactccgttctcgacagacctccaacccccgcgactatacttgctggctccgaagttagcaacttgtgccactgcatatagagccctcgggaacgcttcgaagatgattccaacatccaccttgccgctatcgagcttagcgcccggctcaccaggtttgattccattaggatcgacctctactttattattagatgcagctgtagaactcaccacccgtacaccccacactctctcgaattcaattaagcagtaggggcagcctgaccggcatacccccgcctcgtgatcctccaagcccttagataggagcgtcttcgtcatcgaatacctcgtcgaatacgtcctcgggctcttcctcggtgaaggcaccaccgaacagtggatcgtcctcaccgtcaccaccggatacaatctcgtggagtcgtacaccacggagacgcagggccgtcatagtacccttgcctcgcggacccttctgagtctcgatcaggataccaacctcgccagtagaaccaccccacggattggggccatcatacggcttgttgtccgaggtcagaaccaccggcttcatcacggcagacttgcgctcaccgtcttgcatccaatccacgtgcttcttctgcttgaccttgaacaggtactcgccatcacgctcttggtatttgatggtacccttcagacgggcatctttggattccatctgttggaccagcttgtctgcctcttccttggtcggaatgcagatggttacttggtagacttcaccgtactcggtgtccggagttacgatgtaggggaagatcagcttcgctaccgggaaggtgaatcgttgggatactttcttagacatatcttaaacctctcgtagggaagaaggtattataccacagagggggctgaaagtcaacccccagatgtatcagtgtgtgtcataccatgaacgaccagcgatagaatcactagccaaaggacagttaaccccgaggagttccccagcatcccgaacgcagacttccatctgcctacggagagccaagagatcatctgggtggcattcccactgaccctcgtcatggatatccaagactttccaagcccgcaggtttagcctacgaacccgctcgtctaggagcaccatggcccacttcatgacaattgcacctgctgcttgtaggagggtgttcaatgccttgtggatcatcacgtcgccagactcagaacgtcgcatggttagcttccgtccgtctagcccttcgagataacccctctcggcttcctgcttaaccctctcaatcagtgcagcaaggtcagggttagcctcaaggaactgggcccggagcctagccccgtccgcccttgtgccaccaatgatagtcccaatcttggcatccccagcaccgtagatgaaggcgtagattaacgtcttagcatcgtcccgtgtgggaagccctgcggctatctggttggccgtgtgtacatcaccctcgaccacctctttggtgtactctgggttgttgatgtaggatgcaagcatccgaagctctagaccagcaccatcgtagcccacgaataccaattgattcgctgggacgtatacccggtactttcctacagtcttccacttacccttcttgagttcctccacgatgttagtgaagggcctaaccctctcgttctccccaagatcacggcggaggacagtccatttccattcaccagcctcaggtgtcccctggaacaacccacggatttcaggtccgaaaggagaacgagcagcggggatattgactactacacggtgcctcatgcggcccgtaggtgttgcacaggggttagcactcccctctaggcgtccatcaggcctcacctgatctaccagcccctgcaagagggaccgacggtgggcccaaaccattcgctgcatcaccagcttgcccaggtctccctggacggtatccatcgactcttcagtcatcttcggagtcgttaggaccttacgttgcttttcgagctttctcttgacttccccaatggtagttttcccagggatgattccctggagcttcattcggagtcgtccagatttgctctgtcggagatcctcaatgtacttattcaaggattcattaaggtcagatccacgtagcttcttgccatcagtgccgacagtaatatccttgatgttccattggtcaggtatccatccctgatccagcatccagtccttgaacttggcagtcttaccaaggtcgaagggtacatactcgattgcagagaagggaccagatacctcgaagtgcccaagacgttgccacagggactggagcctttggttcggcttaccactctttaggaatggcttgctgaaggccccagcccttacgatcatcatgggcatctgggggacagcctcaaggtcaatcttgaggattcgttcgctaagcacatggatcagccacttggcccgctgagtctggaagtagactccacgtttactctggcggctgatgatatcagctaccttgtgctcaacgaacagtgactttctccaatccacttaatcccccttaagacgctccgccagattctctactactgtctccacagcttcgtgggatacaccctccagataggagaggtagtccacggtaccactgcggtccagcttccattgctgctccaggaaggctacagcaacttgtttgagcaggaagtcatctatccgctccatgagaatactcttgaccttgctcatgtaatcaccagtcgaaaatgaagtaggaacacccacgctcacaggccaggtctaccaggtaccaggacaggtcaatcttgcgctggatatccttaacgtcgctcagttcttcatcggatagctcgaacccatcaccccgcttctccttcaggtattgaaactcccatttcttctcttcttgggaggtaaacaagaggtctcgcggatctagctgggtattcctgtcgatgtagaagtcgtcgtacaggttcagatccttctcccgtacccggctattgcgtttaggcgagtaggaactcagatccaggtgggagcctgagaagtagctcacccccaggaatccagcggggaggctcaggaatacccgacgcttctcccggagagtaatctggggactgctgaggaacttccggatgttagtcctttgtatctccatgctcttatggagggcagaggccatattacacaggtacttaccacggacatgtttggaatagcttacatggtcactcatttgtatctcctataggggtaaagcaaccccggacaccttaaggttattataccacacttttctggatttgtcaagccttcttgtggaacactttgtcgtaccacctgtagaagtattgagcagaggtaatcccaagggcacctccccacccggacacgaagataaaccatccgatatccaagtgggaagaggccacggccttgatgtaagcaaactgagccagcgtgatacaccaagatactacaaacccagccttgatcttatcatcccgaaggagcttagagttcaggcccaggaggaacacctggaagaatgcactccaaaagatgactaggacttgtagggttattgacatgactcacacacctcggggtctaggccgcaggcactacccaaggggaagtcatcagcgtcgatctcggggccaccccagctaccagagaattccttctccagggcgatctccttgagtgcctgatcttccaggctttctttcttactggccatcgtcaatctcctctacagaaacccatccacggacagcaccgatctcattggctcggacggtcatggggttggcatcggaatcaccagcgaagaaccggatgatatccaactcgatgcggtagaagtctgcgttgaacaccttggtgtcctggaacccaacgttaactcgatacttcttcactcttacctcccagtagttcttccaggttagccagtaccttctgggccttcaggttgtcctgcatgacctgggtacgctccgccttcaggagactgatctcgttgtagatccgttcagattcctccgaagactcttggataaaggtcttcaggttaaccagcaccttgtcgaaggaactgaggatgttgctgatgctaagctttcgattgaacatagtgagtcctcgggggcccgaaggcccctcttcatttactttttcttgcgaatgcctttggccttacgatcgcccacccgaccaccatcagcagcgttagaagaacggccacggacgcgaaggttagaatccccgttaccgccaccatctttaacacgtttgatatgatcgacaacctcgtcggttccgagcttcctgccaagacgcttttccacctttcggcgggctcggtgccgctgagcatctcctgacttagagcccacgcccgtttcgccgcgtcgaatagccagttctctctcacgcttgtagttcctcactcgctttttagccaatctacagtcctccattcaacaagctcttgccaagtcatgccgagtacccggaggaggtagttgaacagtgcgtgactgaccactccatcctgaaggcaatactcaaacatttcctctgagaacttggagaagtcgttgaagtcacccttgtgacacttcaggaacttaccccaggctcccagggaatgaccctggggcctatctggccaagtcaacctcgatgcaaccaaggtgtcatagcttcgatctgggggtatgataattccatgaagtttctcaaggacccggttgtcgtagtcaaggatgttgtgaccgactacgaactttgcatgggcgatgatcctgtagaacacatccatttcctcgggccggaatccccggactaccccagtcggaatgtctacaacaacagcgcaccaaagccttgtgaccgtattgaagaggccgtccccctctaggtcatagataacgtaatcaaattggggtgtcatcgtcagcaggtacctcgtcgtaactgccctcacgttcaaccaatcgacccgtctcagggttatacttggtgaacactaggccagtgttaccgtagttcctgtccttgattacacggattcgactctcgtgcttctcttcaccgtcagcctgcttgttccgctcgaagccgatcataagctgacaccaacgctgcatagctcgggagccggtgaactggctttcctttacctcagcgccttcctcgtgggtacgattacccttgggcgggttaaggtgggagaagatgaagatccgaagacccagctcatcggccatacctgcaagctctgtacagatacgggcgatctccgtgttcatttcggaaggactaaggtggttggtcatggcggtcatgttatccaggaggatagtcttcacatccatggctacagcccagaagcgaatacattccttgatatgatcccaatcgttctgacccttattcttccacatgaagagcttgccccggagtttacccgcagcatctttaaaggcttgctcatcccactcgatatccggtcggtggaagggaacattagctaccttccccgcgatattcttcagtgtcatggctacctgctcttccaacaggaatgtccctacgttctccccgtgctcaatgcaattccaggcagcaatctcgtgggccaacagggtcttaccgatgccagtacccccacctaccccgatgatctcaccatcacgctgaccgtaggtaaggttggttagaccttcccagggatagctcttaccccacttagggggttctagcgcctcagcgtatacctcatcgacagttacggaacagtccggggacttaaccttgctaccgaatcggatcatctggtagacctcatccccccgattacgcataagcatgtcgttagcatccttcagggggagctctacaaacttacactcggggtacagggcacgtaccttttctactgacttacgcccctcgtcatcagcatcatggcaatagatgacctcgttgaaccgttcaagtacaccagattcctttaggaatgcgatatctcgtccagcggaaccaacaccagaggaccagctaatggctgcctgacgcagatgcttccacttctctggaagtttcgactccatgatctgagccacggacattgccgacagttcatcctcgcagatgactaaccgcaggtgtcccatatccttatgccgaagggtgttataaccgaaggggtcaacaccacccttggggctaccacgatagtagaaagccttaggttctaggattcggacgttgaacgctcggtactccccttcgcgagtgcgtggatagtaatgctcgataacgtcctcaccattttcttgtgatagaccaacacgtactccgtaccgttcagcgattgatttgctgatctttcgagtatcgagggctttaattggatactcaaggacttcgttgacttcatggatgatatcctcctcggatttctcccttcgttcaggaaccttgaacccttcttcgagaacttcatagtggccgcaacggttacaactaccgaagcgggtacctttctccttgtctacgaacaaratgaggtgattacctgttttayccccacctttagctcggcaacccggacaagccgtatcaccgataatctgcttcacttattcctccatctggctcttgagtaccaagctcggtacagcattgacgttacccggcagggtcttgtaaggagttgttacgaaagtaccgtagaccttctccagttcacggagtcgatcctcgatcttcttcagtcgctcccacatgaagcgaataccaacagactcgtcacagtacccaccatagctggtctcgggactatccgaggactccggaatcttggagacctcgatggagtcttggaggtgtcgttgtgaggcgacaaggcccaggatctccttgaggagcatcttctgggcatgtagctcttggtgtccgaaggtgttcggagtatcgcggtagacttctactgctttgtctacggtcatttcattcattatactgctccttgtcgttttgccaggtgtgccttccagtcgccatcttggacgatatccatcgccatatggctatcctgatggtacaccagggccttgattcgttccccgttgattcggaagtccttgagggtacgatcataccaacccggataaccctccagggcatccaagttctccagcatttcctcccccttctcaccttcagggagttgccagatttcccctacgatgagatcagcgcgggaggcaaaggagaggatggggaagccgccagcggagtacatcagaccccgctcgcaggatacagcattgccgacaaactcggccccttccagaaggtagtggttgtacaaaccagacaggagagtaccataaacgaaaacacgaacagccattagatagtctcctcgaagattttgttgaagcccttgacgtaggcctccagggcgctgccttctgcatccaggcccggcgcggtgttgatttccaggacaaacgcccggctagtagcgtgctggtagatgatatccacagcgccgaagtccaggcctgcaacttggatagcttctgccgccgccgacatagcctgctcagcaccatcccgatccattgcatcgttgacgccatagacccagccgcccgctacgttacgtacgatgctttggccttcgttggttaccatatcgttggcaacacggcgtagcttgacctggagcagggcaacttccccacggatcatgtggactcggaactcggtacgcttaccgacgatgccctgggtgaacagttgggcgttctcgacgacctccggaatgtgggtatgaccccagatgtgtaccgggtagttaccctggcgacgaagggcatcaatggcctgcacctctacgtcgttgatgctacagatcagatgaatacccctgccgctatgaccattgaggtcggtacgaacgtacatccgaccacaggaggccaggatcgggtgggcattggtccaggaatccgtccagcgggggatcagatggggggcgttggcctcgaagtggcggaagaagtccagcttgttggtgcagcgagcaaccatggccggatcattgaggaataccggggcgataccctggaggcgtcgtgcctctgcacctacggtaccccagttgattaccgcagtacccgcacggccacggtaggtagacccctcggaccgaaggattcgggcacccagggcattgcgaagatttacggcaccggaagacgctcgggaacctttgtagatgtagaacatggcatatctcctgtttctgttgagggtagtagtgaagccagcaatagcccctgaggtcctaagtttaaccccatgtacacatcttaggaaccggcatgggtcggccaggggctattactaacgcactaccttactcgaagtaatcttcgaagagtcggtcgatagcttccgcaatgactaccggggccggtaccaggaattcttcgtccgggttggcatcattgagttcctgctccttgactcgacgaatcgactggatcttgtccagggtgtcacgggagaagggatacttacgggttgcgtcggtttccatctggatcactacttgacgcttgagagttacttgggtcattttgacctcctatttattttcgattacgcattcgccgcagatgaactcacactcatccaggctacctgtgaacttggcaccctcgtacaccgtcagatgacgattacgctggtcatacgcggtagggatcttaccgcaggatgcacacccttgggatacgaagtcccgaaagacatgaacgttgttgaacgtgtgtccctgaaccttcaaggggtagctgatgttggccggaggggtattccccaaggtgccgccgacttgaaccctgggtttagaatgggatttcgtctccgatgagatcgttccaatcctcaaaaccggggtagtctccccaggagtcggccgatgctttgggtccaggcaacttaccgccagatcctcgacagtaaccttgagatcacggtcttggccgatgaagtaggcgttggagatacttcctcggaggacggtgtagccgtggactttggcgacgttgatgccatgagcttcgatgagaaggttttcttcacgctcgattccagtgacagttccgtactcgcttccgttggcgtaggcctcgaccttgacaacatcgaaggtgacgagttggcggtgcttgaaggtgctgcctgcggcgtcgaggttgttgttgatgcggagggtgttccttgcgtacgcatcgccagacgttccatacgacgagcccgcttggctgcctttcgttcccgcttggctgcctttcgttcccgcttggctgccttggcttcggctatagttctcgtagtcggagacaccgacgtagcgaccccaccatgccgcttcttgcctttcgctttcggggatgggaaggtcgagaaatgtaaccggagtggtctggggttctgcaccctttcgcactccggcctccgtgaacgggatagttaccaggacttcagccttcagttcagcgatgggagaacgaaggcggatcttagcgttgggacgctccaggaaaaccttgagcataccaggctcggatgcccacacgatggtaccagtggtggtcaccgccatgaacaacggacgctcatcgttgcggatgaagttcagggtacgttccttggagtcccaccagattaccgcagcagcaccggagaacttctcttcgaaggtcttcttggcgccgtggttggcaatggtagcgcacagcatgttggagtccacgttgtacttgtcattgccgtccagcaggtggagaccccaggaatccacagtcccgttatgtaccatggtgatgtggtcaacctggaaggggtgggcgttcgcacggtccgtcttgtcacccatggtggcgtaacggttatgtcccatgtagattcgagcccgacccttatccaggaactccttggtttcaggatcagccaggaagtcgtaggcatctactgcccgcttgtgaattcctacctcgttcttaaccgggtcgatcttggccagaccagtggcgtgggcaccacggataatatccacggccaggagggattttagaagagcgatttcgttatcactcgcgttagttgtggcacagaagcctaccaatccacacattgtttatctccttagtacatgttttcttcgagtcggaagccagcatgacgctgcatatggtccgggttgtccagcagaaggacgaaggaatcacgaagaatctcgttatcctctatgaggtctcggacgcttacttggtgcccgatcatcctcagggactggacagtggtaagaacctgatccatccgcatgttactcccttcgatgatagccaggttgtaacgctcaggggcaccctctcggattctacccatgacgcttcgggcagccatcaaccgacgatccagtgcccgttgttgttcacgagcctgctcgcggagacgacgctgacgattctgctcatcctccaggggatctaccccggagcgaacaaaacccatggttgcaacggccaaggatgcgcttgcgatacccatttcccggccacccggagacatttcatagtcaggggctacgccgaggaagaagatatcacgaaggttcacatccgacaggaccttaacgaactcacccaagggggtttcctcgtgggcaatcgcgaacgccttgaggcacatcatccgctgcatcagcccgaccatttccgagcgagtggtcatcgcgtgggcaccacggaactcgatggagccgaagttgtgggtgacctggaggttcaaggccgagtatttcggccaggaggtaaggcccaagaccttctctcgatcaccctcgggtgccaggatgcggcgaccgaaggtctgggacaaccagtcgttgctgaagaaggggatacagaagttgctatcccggcggtacggttggcagtgatcgaagaatacatcctcgaataccatgtaggccaggacagtccgctcgtaaaccttccagttcacatcccgcatatccatgtgcaggtgggtagagcagcggaaggtgggtgccggggggttctgttccatggcattcacgaaggcttccacgcggttaatcgcctgttcaccagaagccggaccagagaagacgtactccataccatcccgtagagatccatcgttcttgatatcccagcccactacctcgggccactggtccaggccttccagttcaacctcgaacccgaaggaggcaacagcagggagttcctcgtggtgttccggaaccttgctctggttcttacgaaaacctatctgtgtgccaataaccgacatagcaaatcctcctggttcttgaattgttcatctacagacagccggttgtctaccatctgccccacctttacacccttccagttgactaccccatctttgatgaagaagtcacggtgggctgggtcggagatcatttcttccgcttggaggaagatacggatcatcatctgaccggttatcgcctgttggccgtggttaatgaggatattcctcgggtcaacacccttgcgctgggtacggttgttcacaaggaacgacacgtaggtatctcgctcgccgctaccgaagacatcatagtacccactcgggggccgcacaccttcgacctcgctgtacacgacgccgccgtagtattgtccgccgtcgggacggaagatattacccaggagacggaagccatcgaactggcggtcatccccgatggattcagtgtcatccacgtagactacccgaggctctccgtccacccggaagaaggcgaaggtggaactgtagtacatgttgaagtcgccggccagacgatgcctgttgttgaggtcattcatacttcacccccaaggcctgaagagcagcgaccgccgcaacgccgtcgttctcgttgatgattcgctggacttcatcgccagatacgatggacttgtactcttccagcaggtgcttcgaggtgtaggcttgtaccgccatttcgtagacccactcggtcaggttgacggagaagatccagaagttggacaggctacggtactcgccgccgtagggcttgtagcgcatcgcaccggccttaccgtacagcttcttgcgctgggtatcgccgtcgagcaggacagaggccaggcccaggaggtagtcacacatctgcatgacctcgcgggtggtagccttggtgactcgctcgatgtggccgaagccgatatggacgtggccgccagcagtacgcagggtcgggggtgcatcgttcggcatcacgttctggcgacgggtccagcagttgtagtccggctcgcaaccgaagacgtaagcctggggaccgaagctgcggagcagttcttcgtcgtacaggtgggacgacaggttctcgatgatgttcataccgaaggggtggagcacctgggcacccaggagtcggacggagacgatacgttccacgaactcttccttggtactggccgggtcgatgttgtactccagaagaacgttgtcttcttggacagcaccaccggctacagccaagggctcttccttggtgccgccgatgaagccgatgacgctctgggggttacggtcgtagccgacgaaaacttcaggatctgcaccgatcagggggattgcgttgttcattgcatagtctccagtgtttcgaggatttcgggaaggtcgtaatagccagtgggcaccgtgggggaagtctcccgtccggggtcccctacgtcgatagtgatgggcgccatgatggagaggattcgatcatcgtgtaccccctccaacccatcgcactcgatcaggtagtcgtccttggtatagcctttccagagggggtcatcatggtgcttgagcttatccttgaactcttcgcgagttcgtccctggatgctcttgatatcgaagtaggtgatgttcttccacccacccgtcaagtggtccatgatctcgctgatgtagctatcctctacatcatccccgttgtcttcgcactgcttcttatattccccagcagtcacggggaacatcgccggatagctgtcgcagtgggcagtgctaccaacctgggcacaagccgcgagggtcagaagctctgcgttgaaccccaggattttatcctgagattccttttgaaaacgacgcatctgatccccgataccccagagacgatcgcccatacggagtgcgcagatgattgccgatgcgttcttcttgaggtccacccgaacgtacacagcctgtcggcgaccaggggtgctgaagtggttcgggtcggataggttatgcttaaccccatcgtaccctgcccaccacttggttggccagtcctgggaagccgagaggattccaccgtcggtgatcctgttgaccagatcactgttcaagaactccaccagcttaccagcagtgttctcgtgggtagacaccaggaggtgtccaaccccggtctcccacgctacatcccggataggccccgtcgagtcgcagaatgcaccgaagcagttggtatattcagccacgtatttaacacagcagtgaccaacctcagcaccctcggcatcgtagtacacgttatgggctgcatacattcccatttgatttctccttggttgtcagaagtttttctcgatgaatccttccagggccagggggatatcccttgagccgcgaccccagtgaatttcacccatggtccccagcatgaccactccgtgtttttcacagtcagaaggagtaagccggaggaatcctcccagttccgtatccacggtgtcgtagggggttttcttgccgaagatggttggctgaggtgctatggtaactacctccaccttgttcagcttaatccccaggtattctgacctgtagggcttggaccttacccactcacgtccacctggggcattacggttggccacccaacggccgaatcggttgcactcttctgcggactggatgtggatatcgcctttcttgatatcctcccaatcactactgaacatgtagttggtgaggggatacccggtgtagccattggctatcaacccatggaaggacattgcgaggtaggacttccagaagccatacttctcagcaagccccatgtggaccccctcctctcgaccttgggggtcgagtccgctggataccagcttgaagaggaacttcatgatgggataccaggaatccagggtatgttccttcgggttgaagtagataccgcaaaccccatccttcccgtgttgagtgggagagatcaactccgacccgctaacgtacttcacgaacggggaggtcttggccttgctttcgtaagaccagaagtgaaccttcgggatcttgtaggccttgccgccgatggtgatggtcttgagttcaccttgggtacacttattgagtgcatcgatgaacttcttgctgcgacgggagcagatgaagatccaaccgtcgagcttataaccatgggttaccaccccctccatggctccgaagcaggaggcagaggtcattaccttgagggccttaaccccgcccttcttggatttcataccgaaggcgtacttgatacgggccatttgttttctccttgattgagttagccagcaatacccccagggagttcctaggggtattactagcgacctctaagttacttagaaggtgccacggcgctgttgcttgcctttggtcggtgccgacaccttggtggccttgaggttgccgttcagggtcaattcaccgttggagcagagacgctcgtagaaaaccttacgcttacccattgtccacccccttagcgaacgttgatgaagggcatggcttggccgccggtgacgtaggtgggcagctttccgtcccacttctcgatggcattcagttctaccacgccggggttctggcggagggcttcaccctggattcggaggctttcggccttaccttgtgccaccaggattgccgcttgcttttcaccctcggctgccgcgatagccttggctgcctcggcctgggtctgacgcagttcgttctcacgctgcatcgccgtctgggtggccttgatcttggcattgattgcctcgaccacctgggccgggaggccgatcataccgttgaggtacaggctttcgacgatgataccacgggtggagaagtgctcacggacggcagcttcgacttccttcacgaaggcttccttgccaggaccatagatggcctcggcggacttcttgctgctggcgttgttcacggcgttacggaccacctgcggtacgttcacgctcacgatctcgttcatacccttgcggtaggtctggaacagcaggggtgcgctacccggagcagcccggagggtgacgccgatggggaagtccagcttcaggccgtccttgtcctgggcagtaaccaccgcaagatcgaagttctggttgaaggtggggaacttgaacagttcttcgttgggagtcaggaacttccagccgaccggggtttccttcaggtcaacacccttggagtcgcccatcatgttgacgacgacaccggtatagccagcgggaaccttggagcaacctgcggtaatggcgagggtagcaatggccaggaggccgaggattttcttcatagggattccttacttgtagagaaggggagtgatgtagaccatgcacaatgcgatgaacatgatgaacatcagtacatagaagccccaatcatgcgggggcttacctgggtggccaagcaggccttctatcttatgtatgttgtcgtagaggtcagaggtatcttcgccgataccctccagatccatgtggattgccttacggaggcggtctcactgctgttccgtcatagtacatcacaccttcaccttgagggtttcaccctcgggtatcgccacgaaatacacggggagttcccgagggtgaatgtacaggacactcccattgcagatgtttaccatcgggatggtgaggtccttcctggattccgaacgaagatatatctgagaatcgcgcttacgttcgaagtaaagggggagggttgggcccttactgattctcgttaccgtggccacgatgcacctccttctttacagagagtttacctgcgtaggagtacaggtggctgacagcccagagggagtacaggatggagattaccaggagggcggcaccgatggcgttaaccatggtgttagcgggggaaagcatctggggtactacccagaggatgcttacccatgctgggatagccagaagcattacccgagtgtagagcttgaggaccattgttcttacctctttcttaagatgaagaagatagaaggttagaaccttaggtatcctagggatataaagcaaccccggacaccttaaggttattataccacactttcagaagaatgtcaaggtctagatgttacagacctttgcagagcttgtcgaggtattccgagtgctcgacagtaccggggaagtcctgcaaaccaccgagtcggcggaggaggacaccgtggttgatgaggatctctgccgcagcttgcacgttgatgacgtgtacacgaaccttcgtcgtgtggttggcgctggacgcccaggggttgtagtggctgcccatgcggcggaggatggtgtctgctaccacctgctcgttgttcacggagaaaacggcggtgccatgaccttcgttgtactcacgacggatgacgccgatcagttccctggcgaaagtcctggggctgaacccattggacgcaatgccggcgtagtggtcagcagtaccggagggacccatgccgatgtaaatcttggcggtgcagcaggaggggaagtctaagcgttgcattagtaatctcctttgataattttgtagaaggatatgatgaagagtttcatcgggaagatgaggtaataggtcatcaacccgaagaggatcagtgggagtgataggggccacaacccgccaatgacgatggcgtgctcttccttgatccttccactatcctcgaatagggccaaggtcacgcacactcctacggcggccacgaggaagtagatgaagaggcacatcatgaggaagaaggccgccgctgcatagacgattacgctttccattagaacctcctgtagtggccgctgaagagccgcttggctgatatgaagacttccttgaggggcctgtagcaggcgaagtacaggatcatccccggcagggacaagggccagaagaaggacaggagaactgcccaatcacgatctgacccccacctcatcccgcactcttccaataccgcatagatcaggcaggatgtgaacccgtagaccgccaacccgaagaagatagtggcggagatcatgaggatttcttggatggtcatcaccaatccctcgcgcagttgcaacaacgaccctctttggggccgaagactggcatacagtgggggcaaggctcaccagattggatcatggcctccctggcgtggcgcaggtaagccgatcggctcgactccacacctacggctgccaaggtgaagccaagctcaccacggggctcctgggtgccttcctggaggctcatgttgaacccccgcttttctacacgacgcttcatgcggcgctcctgggccatgatttggccgatcattggtttactcttcatatggtccccacaccttggcggatacatggacctccttagccgggtagagttccccgatgttgggcatggtctgggcttcgaggatgctgaacccgctctggctgaggacgacaaccttattaccttccttgaggaagacaatatcgccagagtttttagggttcacataaaccccatccgctcgcttgctgatgtgaaggtcgttccgggggcgggacgctgctacagtgaaggtggtgtttgacatggttgcacctcagtggacccgatgaaccttgtggtccaccggaatgccgagttcgtaaagggtttcggtgatgaactggccgaagttgatgaccttgaggtggaattcaccatcggcgctagccagccaatagacttggggttcagtggatttcatagacgatacctgcacgtttgccgaagatcgacacacggatatgagtaacagaccagttagggtacagcttggggttaggctggtatcgacggatgacaaccttggataccaaccagtggtagatgtattgggcgggcgtcatagtacacaccctaggccggtgggccgaaccgatggacttcgatggacgcagccttgatggtcacggggtagaacccgcagtcaacatcgccgctgaagtatacggcacccacgggtccaccgaagatatccacgatgaagaattcatctgcaacttccatgtacataaagacacgcgggtttgcagccccgtcctcgtcctggcggatgtacagacgccccgactccagatcatcccaagaggcaacccggatcttactggtgagcatattgtagttgagtttcatgttacacctcgtagcaattcagctcggcagttactgggtataccaggctcaccggaggcatgtagatgacgttgccagtcttgagattgagaacgggaacctcgtcggattcgcccttcatcttaatgctgcggagttcgcagaccatgtacacatccccaccgatgaggaatgtttgggatttgaccaggttgttgagggttacgccgttgcggggccagattttgatatccattgccatcagctcctgagaaggctataagctaaccatgccataaacccgagcgttagcatcgtagcaatcgccatgtagcagttgaaggatttagtggttctcaccttaactacctcacgatgcaaaagggattctgtccaagatcgaggacaggacgaagagaaccacccacactaccagcaacaacccattggaacgtgagcgtatggcggcacatgcaatatacttccatgacattaccgcgccctgttcttagccagcgatgcacgcttggcgcggagcttgttcaactccaggattttaccaaggtgattgccgctggagttggtcaactcacgagttactttggcgatcttgcgatcgatagcctcgatggcttgcatgttgcggctgaccttacgatagtcgttgcgtttcacgggatagtttcctttgttgatttcccaagacgccccagcctgcgaccataggtccggtgggggtttcggccaggaatcaccatggcctcatcagttgggttagttaatacccatctcttccttccagtcacggaagaagaagtatccgataccaatactggatacaatgatagcgatggtcatttgcttagtttccttatgagttcctggcgctcaacaatccaccggggatcgggatgcacccggatcatcctagtgagtttcttgagacggttaatcatctgagcacgttcatgggcggcttcgtagggtgacttcatttgatccacccgcagacgctcagacggataccatccgtagagtatacaccgcaggcaaatttaccgtccttaaaaacccagcggtaaacaatacccccttgccaacctacccttgcatcgcagaaaccagacacataaccccgatcttggatggaacgagcctgcccaaagatacagtaacccacggaaacctcctgatggtctatcgctacaatgcacggacctaccatgcactctagggatagacctggggcgcgtcatagtacacaccccaggcgcacccgccgttacgctgccttcgcttcgtccttgacttccagtcgttggatgatggcgatacgctcgtccgctgcctggagctggcccttgtcgatggcgcgttgaaccttggccttgaaggcggcgatggcttggtccagggagaactcgtcggccacgtcacgctctttcttgtacttgaaccagggtttttcggctgcacgctccagtcgagtggccttgtccttggcgaagacgaacgggaattccttggccttttccttgtcggtattggcctcgatcttgccgttgtctacgaaccagtgggccagggccagccggcgggagccttgcggcatcgcgttgaacagcttgcatgccaaggacacctcgccatgctcgtcgatatgcttgaggatctccatgccggtggtttgaaccagcttgtccagggcagcaccccggttggcaatggtcttgatgatcccattgatacgcttgtagtcgctcattgtatttacctcagttgtttacttcgacagtgatgacggcagagttaccacacttgccaggcttataccagttccgaaggttagtaacctcacggttacgccaatcggtactcataagagccttgcgtttacgcgcacctgccttttcttgcaacgaagtggtcttgtcgtcgaggatcttgttacaacttgcaataatcccaaacttctgctcactacgctgttgggccttccccagattcccaaggttgtaacccaaagccttggccttgcggttggccttgcgacgcagctttttgtcaagagcctgagtcatggtcgtttcatccttttggaatcatcagccgggacacacatcccgatacgacaaaggggtttatcggcaaaccttggcattggcgtagccggcccctttccgcgttagtatcgctgttatggtctgtcctctggctatcctcgggagtcttcgtgtctactcgtccctaccttcgccagtatctaccaagcttcgccctctgcgctaagccttcgacactaacccaacatactccccgtcgcgcttgaaccacggggtctgtcaattgattgcgctgggacaggctaccagtcgggccttctatggtacaaggccaggacctacgctctttcggagtgtgcgttattccctcagctttcgggtttctcccttgttcagtccaaggaccgtcgaaggtacactttccccaggtggccgtcacctgatgggtgcccatgttagaggcttgggcttgccttgtcaaccctctgacgggggttagttcgtccagttctctggcataggctcttttgctgagcggccatcagtcttgcttgtcaaggctacgctaatcccgagggagtcatgcacgttatgccgttgactacggggcgaactataccgcttcaccgatcccttgtcaacccccgatgcctgccggtcttatacttgggtgacttgggcgctcttccctggttggcagcccccggtagtgtccgtagactcgggggatggtggcctaggtagaacgtgggggccattagacccggttccgcggggtttgtcaagcccctggggtttcccccgatgcctatcggtttccctcaaggcggcgccattacgccatattctttacggggttgtctactggtttttcatacagtctatggactatcagtcccccagcaaacccccggatatagacagtctttgactaacatagagtatcgatggaagtcaataggggatcaaggggttatcaagggatattccccccgatccaccccctgaataccctaagatttttcttatgaatacccttgggtctatccgatgaacggtatccctaggggttgacccccggactagccttatggtatcctggggaggggctgggggctagtacccctgggagagggccaccccaacgttagcctgggggactctgggggg

SEQ ID NO: 3 - DNA, 44662 bp, artificial sequence
  BP1430
atattccccagatacaccggaggataaaatagacttttggggtatccccggttataggccctggatcaaaggcacccttcgataactgttggtatattactggataaaggggcaatagaccagggcatagagaacagaggtagccctaaggtatacctatagaacctggatcaagggaaccctatgccacttaccccttaccagcaacctacgaagggtagtcttagggtatatctatagaaccctatcataccgttcgtcgggtaaatcaggtgattatcaaagaaatatcaaaaagtacttgacaaggtatccaaaatgtagtataatagacctataggctcttaagattccttcttccttttgacttacttactaagaaggttagttaccttaaggttatcttaagatagtacttactaagaaggttagttaccttaaggttatcttaagatagtcttaagaacccctttcccattccagcaaaaaccctaacaaaaccgggccttgcgactaaaataaaaaaaaagaagaaaaaagacttgacaaaatagaaaaagtgtgatataatagtattataaggttgagaaattaccttaagatttcattgggatgtagctcagttggtagagcagggagctgttaactctcaggtcgcaggttcgagccctgccgtcccagccaacagaggtcgttgtagaggtagatggctactaccatccggctgtaacccggacgccattggctagaggttcaattccttccttcgaccaccattaactcctcgtagctcagttggttagagtgcctgtcttggacacaggaggtcgtaggttcgagtcctaccggggtgaccatttagagagatcggagcagtgtatgtcagacgaaaaggttgtctcgattggggctgctcctctttctgctaaagaaaagctagacctctattgtgaggctctagcagatggtatgaacaaaacccaagcgtatatagccgctgggttctctcctaatcatgcgcaacgcaacgtagctgcataccatcgaaagcatgccgaatatatcaacgcctttatctctgagcgcatcgggagtcatgtccccatggcgcttcgtgtggttgtagagattgctagcaacccagaagagaaaggtgggattcgcctcaaggcagcccaggatatcctggatcgtggaggcttcggagctaagcagaaactggagcttactactaagaatgtggaagatatgtccgcagaggatctaatcagtgaagttcgacgaattctcgacgaagagccagagttggctaaagtcatttctttcccaacctcttaagtaccttgatctaatcaagcgaagagaggggttggtactaaagtggtacaaagactccctcgggaagataactggcggttatggccacttgcaactccctggggaagacggaccgattaccctagcacgagcagagacttggctagagaaagatagtaaggcagcctatgatgcagcccaagggcaagtatctcagctgcctttttgcactccagagctattcgatgccctcgttagcgtcaacttccagctgggtacagcgtggacgaagaagttccccaagacgtggaatcttctgaaatccggaaggtttgatgaggctgcatgggaggcagaagatagcctctgggctaaacaaactccagtgcgcgtaagggacctccaacgggccctgtggcgtgcatcaacagtaggtgacaaggtggtctaatggatacccaagagcggctacggaatctagtcagggagttggcggagcggcagaagtatttccgcatgaaccagtacactccttatgggtggcaagagaagtttatcgcagcttcctcgaactgcgcccagttactggctatgactggtaaccgctgtggtaaaacctacaccggggcctttatcatggcctgccacctcaccggtcgctaccctgagtggtggactggtagaaagtatgatcgtccagtgaactgctgggcggcggggatctccacggataccactcgggatattctccagtccgaactcctaggagactggaagaaccctgaggcttttggaacggggatgatccccaaggaagatatcgtagagacgattcgtagggaaggtaaacccggatgtgtgcaagcagtagttgttaagcatacctccgggggcctctcgtccctcatcttcaagtcctacgaaatgtcccaggacaaattcatgggtactgccatcgacgtcatctggctcgatgaggaatgccccaaagatatttatacccagtgtgtaacccgaacggctactactgggggtattgtatatctgacgtttaccccagagcatggcctcacggagatcgtgaaggacttcctccaggatcttaaacctggtcagttccttgtccatgcaagctgggaagacgccccacacctcagtccagaagttaaagagcagctactctcggtatactctccagcagaacgcaggatgagggccgagggtgttcctatgctcggatctggtgtagtcttccccattctggaagagaagtttgtatgtgagcctttccagatccctgaccacttccataggatcatcggtatcgacctcgggtttgaccaccctaacgctatcgcctgtgttgcttgggatcctgagaaagacaagtattacctctatgatgagaggagtgagagtggtgagacccttgggatgcacgctgatgctatctacctgaagggtggtcaccagatcccggtagttgtcccccacgatgcctttaagcacgatggagcaacctctggtcgtagattcgtagaccttcttaaagatgaccacaacctcaatgtagtgtatgaaccgttcagcaacccaccgggtcctgatggtaaacacggaggtaactctgtagaattcggtgttaactggatgttgacccgtatggagaatggtgatctgaaggtgtttaatacgtgtacgaacttcctaaaagaaatgaaaatgtaccaccgaaaggacggaaagattatcgacagaaacgacgatatgatctccgctacccggtatgccctgttgatggcttcccggcatgcacgtcctggtgctgtacgaaacagtggatactacaggagtgatactgcaaagttgacccctgattggtttgggagtattgtctaatggctaagcgtcgtcgcaagattaagcctatggatgatgaacaggtacttcgtcatctagaccaacttgttaacgacgcccttgatttcaactcttcggaactttccaagcagcgttctgaggccctgaagtattacttcggagagcccttcggtaacgagcgccctgggaagtccgcgattgtatctagggacgttcaagagactgtagactggattatgccttctcttatgaaggtattcacgtcaggcggtcaagtagttaagtatgaacctcagactgccgaagatgttgaacaggcagagcaagagactgagtatgtgaactacctcttcatgcgtaagaacgaggggttcaaggtaatgttcgactggttccaagacactctgatgatgaagaccggtgttgtaaaggtctatgtagaagaggtcctgaaccctaccttcgaacgattctctggtctctctgaggaaatggtagcggatatcctggctgatccagacactgagattctagcacagagtgtggacgaggatggaacctacagtattaaaattcgcaaggacaagaagaagcgagagattaaagtcacctgtatcaagcctgagaacttcctggttgatcggttggctacctgtattgatgatgcacgcttcctctgtcaccgtgagaagtataccgtaagtgacctgcggctcttgggtgttcccgaggatgtactagatgagcttccatacgatgagtatgaattctctgatagtcagccagaaaggttggtacgtgataacttcgatatgactggccaactccagtacaactctggggatgatgctgaagccaaccgtgaggtatgggcctctgagtgctacacccttcttgacgtagatggggatggtatctctgagttgcgccgtatcctgtacgttggtgactacattatcagcaacgagccttgggattgccgtcccttcgctgacctgaatgcctatcgaattgcccataagttccacgggatgagtgtctacgataagatccgagacattcaagagatccgttcggttctcatgcgcaacatcatggacaacatctaccggactaaccaagggcgctctgtagtcctggatggtcaggttaacctcgaagacttgctgaccaacgaggcagcgggtatcgttagggttaaggccatgaactctatcatgcctctggagacccctcagctgtctggggaagtctacggtatgctagataggctagaggcggataggggtaagcggacaggtatcactgaccgtacccgaggactagaccaaaacaccctacactctaaccaagcggctatgagtgttaaccagttgatgactgctgctgagcaacagattgacctgattgcccgtatgtttgcagagactggtgttaagcgtttgttccaacttctgcatgaccatgccatcaagtaccagaaccaggaagaggtcttccagctacgaggcaagtgggttgctattaaccctgccaactggcgagagagatccgacctgacggttaccgttggtatcggcaacatgaacaaagaccagcagatgctccacctgatgcgtatctgggaaatggcccaggctgtagtcgggggtggaggtctcggggtccttgtctctgagcagaatctttacaacatccttaaggaagtcacagagaacgctgggtacaaagacccggatcgcttctggactaacccggattctcctgaagctcaacgggctaaggccatcagagagcagaaggaagcacaacctaagcctgaagatatcaaagcccaagctgatgcccaacgtgcccaatcggatgctatggctaagcaagcggaggcccagatgaagcaggtagaggctcagatccgactggctgagatcgaactgaagaagcaagaggctgtccttcagcagagagaaatggcccttaaggaagcggaactacaacttgagcgtgatcgtttcacttgggaacgggctcgtaacgaagcggagtatcatcttgaggcaactcaggctcgggctgcttatatcggagacggtaaggtacctgagactaagaagccctcgaaggcagtgaggaaataatcttgggagaacgttttggctatagtctagtgctgactgatgcggcacaacagatggtacgtgagaacgttcttcctgagcttttccgtattgtccaagaagagatcgagggagagtggaagtccacggcacctaaggattcagagtccagggaggccatctaccacgaactacatgccctcaaccgcgtacaacttcgtattcaggctatcctggattcgatcactctaaaggagtataagtaatggaccttgagaatcaaggcatggatgaattcgaggcagcggaagccttcggagatttgctcggtgatgacctcctggcccccggtgatgaaaccgtagatggtaaagtcgtaggggaagaagaggaggaagaggtagtagatgaaggtactccagaggacaccgaagaggttgagtccgaggaggaaccagaagaaggttctgaggaagaccccgaggttgagtccgaggaagatcctgaggataaactctttgagatcccgattggggatgaagtctacgaggttaacttcgaagagcttaagagtggctaccttcgcaatgaagagtttgtaactcgacaagctgaactagaggatcagtatgcagctaaattcgaagagcttgatgctgaacgctctaatctactggccgagcttgagcagtatgctgttaccgctattgctggtgctaatcagtatgacaatgtaaactgggagcagcttaaggcccaggacccagagaagtatcaaacccttcgactggaagccctggaagcccgagaccgagcccaggctcttatcaaacgtcgtaacgacattaaggctatgcaagagaagcgagccgagattgtccactctgcctacgttaagcgtcagacagagctagccaagaaacttatcccggaaatgactacggatgagtcttggggtgacaagatcgtgtcttacggcaaatcgattggatactccgaggatgagatccgagggatatctgatgcccgccaactggctgtactcgatgcagcacgtaagtgggctgaatctcaggtccgtcgcaaggctgccctagagaagaaggaggagactgaactacctgccgcagttaagcctgctgctcgtagggcggaagcctcagagggttctaagcgggttaaagctgcccgcgctaatctgaggaaagaccagtcggttgaagccgctgctgctctcttctcctctctcgacattttctaatagaaggaagtacattatatggcaactccaactaatgccgtctccactgtagagatcaacggtaagcgcgaagaccttatcgatatcatctacaacatcgcaccctatgacaccccgttcatgactgctatcggcaagggcgtagctaccgctatcacccacgagtggcagactgatgaactccgccagccgggtaagaacacccgagtggaaggtgaggatgcaaccatcaaggctggtagcttcaccaccatgttgaacaactactgccaaatctcggacgagaccctgcaagtcaccggtaccgcagataaggtcaagaaggctggtcgtaagaacgaactggcgtatcagctggctaagaagtcgaaggaactgaagctggacatggaatacgccatggtcggtgcccctcaggctaagatccagcgtaacaccactactccgggtcagatggcaaacatctttgcctactacaagaccaacggttcggtaggtgctaacggtaccctgccaactggtgatggttccgacactggtaccgctggtgacctccgtcttctgaccgaagacatgctcctgaatgcctctgaggccatctggcgcaacggtggtcaggctaactcgatccagacttcgagctcgatcaagaaggccatcagcaagaacatgaagggtcgtgcaactgagatcaccctggatgcctcggacaaccgcattgcgcagaccgtggacgtctacgagagtgacttcggtaagtacaccattcgtgccaaccgctggttccacgaaaacaccatgttcatctttgatccgaagatgcacgccctctgctacctgcgtccgttcttccagcatgaactggctaagaccggtgacagcgagaagcgccaactgctggttgagtacaccctgcgtgtaaacaacgagaagtccggtgctctgatccgcgacgttgtagcccaggtctaacccaacggggcccttcggggccctttgtttccccttaggaggtacatcatgagtatccaatcgacttatgcaattgacgaagaccttgggctctttatccgaaaggatactcaagatgttgagtcaatcctgtccgctaacgccgaagagcgccactcgggtgtcaacagtaaccgaaaggataatatgcgcaaggtagcaagtatccccctggttgttgtagaggccctacggaatcgccccatgtctgaaggtggtcccatcgatcttaacctgatcggttgtgacccagaccatgccgcaagatttacccgttggcttaatgaccgagataactatcggatgcggacctctgaggcacgggtgtaatgaatggctacgatcaacaacgtaactgatctcgctatcgccgctatccagtggtctgaccgtcaggatcttacccaagaacttctgatgttgttcattggtaataccactgaccgtcttaaccgattgctacgggtgagggagaacgaatacttcgaaaccctaatggccttcggtggtggcattgagatacctgagcactttgttgctctacgatctatcacgggtgactcccttatcggtggacgtactcttcagtacatcacccaggataccttcacccattatgttaactacaactaccaacctcagggtgtaacctactacactcggttgggtaacttctggagagtattccccgttgttcctgacggtgccccgttcattgtgaactactggactgtactcccagagctaagcctcgctaacccaacgacttgggctctgacgaagtatccgcagatttatctctatggtgtccttgagcagatttatctgtacaccatggatgaagctcggtcccagttctggggtcagaaactcgaacgggctgttatggaactccagaacgaggagaatgccgctgacttcgctagcactcgactggcgatcaaagacattgaacgttaaggagattcagatgcctatctttctaaaaaccctcgcaatcaaccttctggctaccctcttcccaaccaaggtaatcgctaagtccatcgtgactggtgctaaggctctggcggagaagactaactctaaggttgacgacgagttcgtaaaagtcctggaagacaaccttaaggagaagacggaggatgcaacttctaactgataacctgggcagcatcgtcagtgccctggtcgtatcctcggtagtgacggtaggttcctcggttgtcggtcagaatgttaatcaggctctgcttgaaagaaacatccaggccacggagaagctcacccaagcggtgagcgatctccagatttctatggcaatctttggggagcggtatgtcacccgaaaagaaatgaaagaagagataaaggaggccaagaatgggtcttgaggtcgcaacttacattaaccagttggtgcctacgaaccctaccggctctgatctgaaatcctttggggatgaccacctgcgtctcattaagagtgctattaagaacaccttccccaatatttctcaggctgtcactgtaacggcagcccagctaaacgcagtcgctgatacaacccagtatgttaaacctgggatggttatcatgtgggctgggtcactagctcagatcccagcaggttggaagttgtgcaatggggtaggtactacctctaacgggattcccgtccctaacctgattggtgcattcccttggggtatcgatggttcttcccaggctgtagggactagaggtggtagcgctaacatcgtatgggatgggttcactgaagggactgcccttaccctagcccaaatcccatcgcacacccacacttggagatcccgaggggctactaccctcaccggttctgcgggtgactctggtgctctgacgggtggctctggtaacgcagccaataccaaccttgagactggccctgctggtcaaggtcagactcacaaccatgcagtaaagatcaacatgccgttgggtaatatcccaccgttctgttctgtgttcttcatcattaagaactgaggtatacaatggccctagagagacaagaggtcaagaaccctacggggattgtgaccgatatcgcccccgctgacctgccactggagaaatggtccttcgggaacaacgtccggtttaagaacggcaaggctcagaaggctctgggccatacgcctatctttgatacagcccaggccccaatcttggatatgtttcctttcatccggaataacatcccctattggctcctgtgttctgaacaacggttgtatctagccgacgggactacaatcatcgatgtatccccaggaccttacgctgctagtataactaacagatggtctgtaggatcgttcaacggggtaatctttgctaacgatggggttaaccctcctcatcatcttccaccgtcagaatcaacctttagggtgctccctaacttcccagcgaatactacttttaagaggcttaagtcttttaagaacttcctggttggcttaaacgctacaagtaactctgtagaaatgccacagatggtctggtggagtacctcggctgatgctggtggtgtacctgcatcttgggacccaacggaccccactaaagatgctggtcagaacaccttggctgataccaatggtgctatcgtggatggtgtgaagcttcgtgactctttcatcatctacaaggaagactctgtatactccatgcggtatatcggtggattgttcatcttccagttccagcagctgtttaacgacgtaggtatcctcggacccaactgtgcaatagagttcgatggtaaccactttgtagtaggccacggtgacgtatatgtccacaacggtgtgcagaagcagtctgttattgatgctcaggtccgtaagttcttcttctcggatattaaccctgacaactatcaacggaccttcgtaattgcagaccacgtgaatactgaaatgtgggtatgctactcttccactaggtctgagccaggtaagcactgcgacagggctatcatctggaactggaaggaaaacacttggagtatccgagaccttcccaacgttctcagtggagcctacgggatcatcgatcctaaggtgtctaacctctgggatgacgaccccaacccctgggataccgatacttcggtctggggtgaaggctcttataacccagcaaagtccagtatgatcttctcgtctttccaggataagaagttgttcctcttcggtaataactctaaattctctgggcagaacttcgttagtacccttgagagatccgatatctatcttggggatgaccgaatgatgaagactgtgagtgctatcatcccgcatatcacgggtaacggcacctgcaacatctgggttggtaatgctcaggtacaaggttctggtattcggtggaagggcccctacccataccggattggccaggactataagattgacactaaacatgtgggccggtacatagccttgaagttcgacttctcctcagagggtgactggtacttcaacggatacactattgaaatggccccgaaggcaggtatgcgatgagtcaaaagtacagcccttcgattccaccacaggaagaggaggaactgctgcccttccttaatgaagaattcgttagggttggacagactcttaatgacctagctgacggctactggggggtctctatggagccccctaagaagctcaagccagggactgtaaagtattttgcccccggagtggtaggtccagtatccggcatctatcattacgacttggataaccaatggagactcgcaggtactaaacccaaggacctgccgggggattttatcctatttaccccacagaacaaccatcagccgatgggtacctgtgcctataggatgaacactgctaaggatgaagtatggataaccatgctcatgtctggtggtaactacactaatggagctactgtcctggatcttccccaggcgtattggcctcctgctgagttgtttatcccggcctattccagcatcatcccagcgcagagcactattacttatccacctccgtctgaccctaacgcacctccgttggatcaagtctttgatgttctcaacagggctactattcagactggggtggttaaccaagcaatgtttaagatcacagctaatggccgtgttctaatccaaggaattccccaaggagcagtcttcgggggtacattcacattccccctggtggtgactccatgattcatttgattactcgtgagaatatcgatctgcttcctaccgtagtccctgctctggcccgagccttcaacaggacggaccttggtaagttttgggacttcgaacacttggttcactctttggttaattatgaggcctatgtcttctaccaggaagagagtggctacgctggtgtaattcaagtgtcccaagcacccctgggtaacatccttcacttcttctggagtggtaagatgcctgggaatgaaaccccggtagattactcggaggtagacgacttcctcggacagttcgcccaacgagttaactgtcggtttatccaatgcgaaggtcgtcggggctggaagcctaccctagagaaactcgggtataccgaagactccgtatccttctatcgtgaggtaactccagatgaacttcctccaatttaatgtaaagcgtctgatggggttcgatgtagaggatgccctagattctcgggcttacaagggtggtagtaagaagcaaaagaccacctctgtctctacaccctatcagcaaggtaactacaatgaactactctcgggtgccagtgattggctacataacgggggctttgaccctaactacggtggcgatccgaacttcgacccggtggctgaccaaaatgctctccagcttagtggcatcgaagggttgggtggtctcgggggtgcccttcagtctctcctgggtagctcaggtgttagctctctggctgattaccttggtccttacgatcccaacaaaactggcttggcgaacgccattggtgcagccaacgagcagatgcaatgggacttcgacactacggtacgtccagacctgcgagcaggggccactaatgctggtcagtatgggagttcccgagcgggtgtagcagaaggtattgctaccgctaggttgctccagaatcaacagaataacgcctcccagttggctttccaagaccagcaggcttacaaccagaataggttgaataccctgggtaacctgtcggctattgctaagggcctcggctctggtaatgccatgcaggtagatgctggtagcatgcttcagaaccaggagcagcaggaaatcaacggggctctacagaagtgggcctatgagaataacgtcagcctcaacgacctcctcgcctataaggagcttatctccggcgatatgggggggaccaatgtcactacttcttcgggtggtggcagtggtggtggcctcgggtctgccctgggtgctctcggtggtgcttccttgggtgctctcttcggtggcccagctggtgcttctgttggtatgaacgcaggtggtagggtagggggccttctgttctaatggcctcccttcctcagaagctgttcgctataggacagaatataggtggtgggcaggagcgggtacagttgagccgtcaaggcccctaccgccccacccaccttgggacaatgcaatcgggagagtctagtggacaatcaaacccttttggcgcaatgggcggagcagcactcgcggctctcctcgggaaaggaagtgagccttcttcagaaacagtaccaagcttttctgtcgagggggctagaggagcaagcgaacgaggcgcagcggaagttgcagcaggtatgggagcgggagtgggaatccttcctagcgcagaagaactcggtttcggacagcagccaaagtctggaatcctaagtaaactatttggaggttaatcctatggccagcatggcttatgaagggtccccaattcgccctagcatcctccgggctgctcagaatgaactggacatggcgcgaatcgcaaggaacaaactgccgctggctgtagagggctcaggtattcctgatcgtgtccgtcgtgctgctcaggcagccctggagaacccagagcgttggtcccgtgcagcccaagaggttgcacctgcggctgaagctactggtcgcggtgccttgggtcgtatcgcaggtatcctcggtggtcctatctctgtaggtgtacaagccgctgtaaccccaggagaactcggggatgcagagcgtactcgtgcagaagaaatggctcaggctagccaagcggttgagaacatgggtcccgaggttgctcaagaggctaaccaatgggcccagggtgtaggccaacgcgcagcccagaactccacaggaggccctacgggggccggtctgttgtcctatggggtaacccctaaccaaccctctatcgagcctgagatcaccccagaggtggcttccgaggctggtgctgctgtagcagatgaggaggaggctaatcgccaggtcatccaacagggtgcagccgagggtcttcgtactggtgctgtaagtcgtcctgaaatggcccaggctgtagttgaagctgatgcccagagagagggtgtagagcttaaaccccaagagcttaagaaccgggtgaacgaagagttgacccagatgaggactatggacaatgatgacctgtctcgttatgtatcttacgctctcattggtactggtcttctggcttcggccctagacaagactggtaaagctgggggtatgttcgctgcttcctatgagcgtcaactggatcgtaacctacaggctgggatcaaccagcagaagatggctgccgcagctgctgatcgtcagatcaaggaaaaggatctggagcgtaaggtggctaaggatgctgctgatgtacgccttggggagggcaacctgaaagttaaggaagggacccttgagcaaaccaagcgtaagactgagggcgtccttgataagtgggtcaaccaagctgctgtagatagggctaatctggagttgacccgacgtggacaggatctagctaatcaacgggctcagctacaggctgaaacaacccgtcgtggccaggatatgtctcaagagaatgcccagcttagttctgctgtacgcctcaaaactgctaagatcagcgctcaggcacgtcaagcggcagctaaggcagcccgaggtgaagctgttactactaaggacgcccttggtatcctgagtgaagtcaatggttctcaggctctgggtggtaagaagctgagtaagactgcccaacaggctattgcccagactgtccgaaatgaacttcgggctaatccgggggctaacccagtgggtattatccagcgggaggctgctaagcttcaacctacgggtaactggtttagtgctgatctggactatcctgccccaacccgataaaaggtacttgacaaagtatccaaaatgtagtataatagacctataggctcttaagattccttcttccttttgacttacttactaagaaggttagtatcctaagatacatcttaagagcctattctctttccagcaactagaaggtgacttatggctctttctccagaactgaaggccgctattgatgcggaactggctgaggtcaagggcctcgacgtagccgctgaattggcttccttgaatgagccagaggttatcgaagaggcaccccaggaagtagcccctactacccctgagcctgccccagacctgagtgccctagtaactccggctgaccctaattctattagctctgcgattggtcgtggggttgataccatgcagtctaacatcggtggtactattgctacccttggtgaactgactggcagtgactacctgaaagactacggcacacagatggccgaggagaatgctcaggaagcgtcacagtacggaacccctgatgttcggtctttcgctgatatccaagatatcccatccatcggttcgttcctaaagaataacattgtagaggctctcccttcgatggcccctgtacttgctggtggtgccgcaggtgctaaggctggctctgtctttggggccccaggtcgtatgggtggagcgctcattggttccttcctgagttccatgggtatcaacgtaggtgccctgagtaaccagatgaaggaactagaccccgatcaaagcaacccatggaccgcagtcctcggtggtgctggcctctcggtactagacactgcgggtgctggtgttatcgctgccccactcctcaagcacatcggtaaagatggcgcttaccagatgttggtccaatcgggactacctaagcaaaccgctatcgaggctgttacccaggctggtaagcatgcagcagtctctggtgtagccgagggtgtaacctctggtgctcaacaggcgctccaggataccattgcctatgatgcagtagggcaggtacaaaccccagagcagttcatggataacctcctgacggctgccttcactggtacagctatgggtactgccggtggtgctgtatcctcgggattggacaccctgggacgtaatcaggactcagctgggtctgccgtagttgatcctaacgcccctgcggcccctcctaaggcttctgagcttgagcctaggggtacggtcaagaaagcctgggatgccctaggaaacgaagctacgtcccttctagagccacttgctaaggcctctcctatcgcccgtgagttctctgagactttcagggcagacatgagtggtaagcgagcctctggtaagaccatctttgaggatcaggaactccaggcaggtaaatggaactctgaactcgataacatcttcgagggtaagtcttcgaaagagatcgacaggattatctcagatacatccgcaggtgtcaataccccggaagctacccgcctccgtgctttgatggatgacgtaaggaacgaggctgttaaccgaggtggaatgtccgttggtactatccccaactatatgccattcggtctatcccctgagaaggttcaatccccagagttcctgaacgacattactccgtacttccagagccgacaagctgctgaagatgctgtagccaactggctggcagaagtctcggatgatactcgtggtaacactgcccctgaggttaaccgactggttactcagaaccagcagaccggggcttgggaagtagaccctcgctatcgtatccagggtgacccagataccctacgtggacggttcgcccaaagcgatgcagttcctaagtatggtcagctggaagagagtcgggcctttggttctgtacctcaggagatcctcaacaagtattccctgaacgatactcctaagaagcgtctccaggaaatccgggactacttcgaaggggcttcccaccggattgcctttaccgaaaggtttggtatcaacggggagaaggctaacgctaagattgcatctgctgtagctgaggctcaacgggctggtaagcgggttaccaaggaagaagtggatcggatgtatgacctggtggatgcctataatggtatgcacggtcgtatcaaagaccctaaccttaagaagctagcggctgttacgtcgggtgccctcgtgctctcaagacttccactcgccggtttctcgaccctgaccgagttcagcctacccttcgctaaggcgggggttatgcctacccttggggctgtactcccaactatgggtgaagtagtaagacaagcagcccgcaggatctacagtggggttccaaagtctgagaccggtcggtttatgagtgatatgaaccacaccctggcttctgctacttctctgatggctgatcgggttggtgctgaggtgtttaactctaccatccaaaaggcgatccgtggtcagttcctcatcaacggcttgtccatcctaacccatgttaaccgaatatttgcaacagagactgctaagcgggtctatcagaacaacctgatggatctagccgcaggtctccctttcagttctgccaatggtgctctgaaggttgctcagcttcgggaaatgggggttaatatcggtagccagcaggatgccatcaagttgatctccccagccactccatctgaagtcctgatggctaacaacgtcaagactttggctatgcgtcggtttgtggatcaggtagtcctcgaccccaccttcgctgataagcctatgtggatgagcaacggaaacgttcagatgttctccctcttgaagggttacccagcagcctatggtaacatcatcctaccgatgttccgtagacgactgagcccacacttcgctggttcttggaccaacgctggtatgggtgcagcaggtatagccttcactcttggtctgatgatgagcctggggtatctccaggatgagcttcgtcaactggctaagttcggtggatctagccgagaggatacccgtagtccagaacaacggatgatggacgtagtgatgcaacagatgccactccaggcttctatgatctacgacatgctgacgggttaccgtcgagggactacccccgcagaggtagtcttgggtccagtagctggtgctgcaactgagggtgctatggctgttggtaaaactatcgcttcgtttggggatgacccatccgcaggtgaaatctggaagttcttgtataagcaaactccagcacgtcctttcgttgccggtatggaagcgatggaagatgctctggatctttaaggagaagtaatatggcaacttatgtagaaactgatgccgctggtcctggtggccgtgcctacgtggttgatgtgccaaaagtcttccgacgtaatgccgatggtgatctcattgagattacctcggatgccggtcgggtgaatactaacatcgttaccgctacagagttcctccctgactattatgcagctaaggagaacgcagccctggtagtagagaacgttacagcctccttcccggagaacccctcagaggccgttatcccctctgttctggtcaacaccctcgtgggtgctcctggggaaacctcgggtggtaaccgtgaccctggccacgtgattggtctattctctgagaccatgattgaggcaccttgcggtactgcattcggtagtgaattccgggtagaccctcgccgggaacacctgggtgtttacgtggctattaagcacgtgattggcccggatgaccaaaatggtggtaccatcggggattacattatcgagcagtttgatgacatgcgtggtcctgtgaagaatattggttctctccaacagaactacctggatccccgccttgtgactactcacctgggtggtaatgtggtcaacactgcacaactgaacggtaacatcacacttacccgacagaactctggtcagcacttcatgagtgtgtcagctacggatatcaccgtgactttgggccccgatgtaaccccaggttgtgtattccactttgtgcaaggggctgctggtaagatcaaattcgctgtctccccagacaaggcttggtacgctaagggtaatcagacggagactgatggtcaatttggggaatgcactgtccgagtgtatcctttcggtggtaccgtgggtaccttcaaatcggcagtttaattaggagttagattatggcaggttatatcgctgacaacgacggcaacagtgtattcgttattcaatcgaaggctattgctgtacgtaatgaagatgggaccctccgacaagtcattggcccgaaagactttgagcctgtgaagtgggaggatattgaggggaagccgaagcttctggaggtgggtgctaaggctagcgaggctaagccaggtaactggaagcctaaggctagtgaagtgagtggccttgatgcagccattgcagcttacgtcaagggtaaggtcgctgagatccccgtggcttcctatacggatactcacgaggcactcgttgataagttcaacacactgctgaacgctctacggagctaaagataaggccccttgggatgatacccttggggcctttttttggttactcgatggatacctacagtgaacctgcccaagataatacatcgatgaggagtctggatatttctcccagggtcaggagtaacatcagtcagctatatcctacataaaccagcagggcaaacaaggctgctaccgcaatgtaggtccaagggaatccacccttacccttttgatctttctgcataacccctccaatctccgtagaatacagaagccctaaggtctactaggtctagcatcccttcgaggaattcaatctgtcttttagcttcttcagccagttcttcaaaggaaaaggccttcgcctcagccttcgcaagagcgctttgcgcctcttcaagtgctttctccagttcagcctttgtcatagtacaccaccttgtcactgcccctgagaacatactcagaatcaatagtccaactcatggtaggacatttgatccgaatcatcttcggagtaaaaccatcaactgtaccaatagctagatgggatgaggtgttcctgtggaccaggaagactacactgtcccctacctctagcttacgtcccactcggtctttcatagattaccccaagatatccggaaggtgaacgcttgggatgtagaggatctccaggacttcgatggaatacatccctcgcctaagcccctcctcagcaccccctttcccaaacttcatatccagccagagttctgcggagatcggcgtcttaaacgccaacccccgttgaccgaagtcatgctcagacttaatgtagtacaggtctggcaagaacttactcacaggaattcctccacactcatcagcttgaggtcatactctccgtccttgtggttccggagaagggctacacctcgccagtggtcgttaccctggggccctttgtaggactcatcatgggtgtagaagctaccgactacaagcccgtggattcgcttcttgcctactgcctcgatgtggtacttgaatccctgctcatggccttggacgaagctgcgcttgatcttattgaggcgatgctcggcactcccgccgtatggccgaccactgttgggattgtagaagtagtgggcgaaggcgacaccttcgataacacccacgtcgaggaaatcatggacaatccaatcggacagatcaaaatgatcgtacccaataaaaccttggagagcagggttagaattttcataccgcttgatacgctcctcgtggtttccgatgaagaagtgcatttctggtcgatagatacgcttcttacaacccgcttggtgttgctgtaggcgacgaagaggatcgagcagaactcgcatcgcatcattaccagcttgtatgtcagcgaggactcggcggccttcgatcttagcggtaccacggtcgtagcttgacagactgggcatgtcccaatggtccccaatatgaacaattcgcttggggcggttacgtgcgatccactccccaaggttcccgaggtgatcgatgttgacctcggatcgaacttgggtgtccgcaatgacgagagtgtcttcattatacttcttactcattagggaaggactccttgaaagtctctagagtaaaccagcggaagccgttacgctcggcccattccgccatggattgctttgtgccatctttacgcttggaaagccaatggcaagctgtgttagggcgctcgaagataaacacaagttcagtatctggggggagagcttccctcacccagatgtacttagatgcctctgaagcttcctggaagtaccccttgacctcgaccaacaggttcttcgtcgatccacagggttgtaatgtcgataccttgaagtccggcttgtacttgtgcttgatgacgtatggcaccggctccggcttgaactgcatccaaggcatcgtctcgtggacgatcttctcggtttcgctgtcgtacttcgtcccaatcaatgacttcagtttgggtctgaagaatctcccctgctttgccaatgagccctccttcttgaagcttacggacaaccgacagtgtactctcagtgaggatagagttagaccgaatcagaagccagatccaatcccccaggcacacccggaactccggatacttcagtttgatacgttggatatgggagacaaccttttcaacttggttgtcagttaggggctgagagtgatccagaagagggtctaggactcggttaagagtaatacacttctcttccttatcaaactcataagactttgtgcggtagatttgagacctcaagcccagccgatttacaggccagcatgcgatctcacacagtcctacatcaaactctgctggatgtgaatgagtggtcacgactaggttgacgggcaggtcaacaccaatagattcccacacatcaaaccccgcaggatacccatcaggcttatctccagtcctacaccggaccttcttgtggcccagcttgttgtagaaccgagtgacctctacttctagggtatcatcatcacaggggatcaaccgtgggccgaaccggctacggcgagtatcagtagggtcctccacgtatggcctacggacatagaggtcgatatccttgggtgcaaccccgttgtctgcatcccgaaggaaaccaccagcgaccttgtagtcagtgaagccaagaccttcgaggatctcaaagagaccttcacagatcctctgtgcttcatcaatagaatatttcttcatcgtcatagggaatctcccaatgtttcttcagtgagcagtgatactcgttaccggactgctgaatatcaagccaagagcggtcgcgaatgaggtagaggagacgaaagttttccacaaggtactccttccaattatctccgtacttctgttggtaggcgtaagcgcaagctgcgaagagatccctctcagtagaaagctccccaagcaaatctgccgctgtctttggtcccgtccctgggaggcctggtatgttatccacggagtcaccaacaaggagttgcccgtagaggaatgccgtaccgttgccctcaagtttccatgacttctgcggtttcttaacaccatacattcgccaagaagcggagactgttccaaggccatcgacttgaaacggtcccaactccggctgggaatctccacagggccaactgtaatggtagcatcctgggacttggcggatatccttgtctctagaacacgctgtaaagttagctccctcttcagtgcctcgaatcccgagccagtcatcagcctcgataccgtggaaagtgattgctccccacttgtccttaagtctggctgacacggtttcccagtgatgaggcttttcaagaccgattcgagtacccttatattgcttgattttcgcaagctccagcctaaaatttccttggccagtaaggtagatttcacactcatctgcatttacccttttgataatttgttcgactttatcatcgacgagcttatggacttcttcctcgggccagggcttttccacctggatatcgaagatgtgttccttcgacatagccacgtggcctagctcatacctgagcacgtccccatcgataccagcgatcatcacactacctcttctacgacctgagactctttgagcttctcttcccagaagacacggagggcaaaggcttcacccttggctcgatactctgggtgctctaccactgggttaaccagtgcctcatagcccttccagtcgtaatattcactttcttgacgcttggccttgtccatagcttcctccgttaggctgtagcctgggggaagccccaggtctacatcgatgcccattacagagtagttactaggaacagtcttagcccttggatccaacagaagttccattggagtcctcctcttgctgaatgacgagttccagggacgctagggcgttccatacttcgtgataccggtggggtagattactttgggggtccaaagcttcacccttgtgtcgctcaaggaggtgtctaccgaaggcagcatcatatcgctggactccgttctcgacagacctccaacccccgcgactatactttctggctccgaagttagcaacttgtgccactgcatatagagccctcgggaacgcttcgaagatgattccaacatccaccttgccactatcaagtttagcgcccggctcacccggcttgattccattaggatcgacctctactttattattagatgcagatgtagaactcaccacccgtacaccccacactctctcgaattcaattaagcagtaggggcagcctgaccggcatacccccgactcatgatccgctaggcccttagataggagcgtcttcgtcatcgaacacctcgtcgaatacatcctcgggctcttcctcggtgaaggcaccaccgaacagcggatcgtcctcaccgtcaccaccggatacgatctcgtggagtcgtacaccgcgcagtcgcagggccgtcatagtacccttgcctcgtgggcccttttgggtctcgatcaggatgccaacttcaccagtagagccaccccacgggttgggtccatcatacggcttgttgtccgaggtcagaaccaccggcttcattacagcagacttgcgctcaccgtcttgcatccaatccacgtgcttcttctgcttgaccttgaacaggtactcgccatcacgctcttggtatttgatggtacccttcagacgggcatctttggattccatctgttggaccagcttgtctgcctcttccttggtcggaatgcagatggttacttggtagacttcaccgtactcggtgtccggagttacgatgtaggggaagatcagcttcgctaccgggaaggtgaatcgttgggaaactttcttagacatatcttaaacctctcgtagggaagaaggtattataccacaaagggggctgaaagtcaaccccccagatgtatcaatgagtttcataccacgagcgaccagcgatagaatcactagccaaaggacagttaaccccgaggagttccccagcatcccgaacgcagacttccatctgctcacgtagcgccttgagatcctctgggtggcattcccactggccttcgtcgtggatatccaagactttccaagccctcaggtttaacctgcggactcgctcatccaggagtaccattgcccatttcatgacaatagcacctgctgcttgcaggagggtgttcaatgccttatggatcatcacgtcgccagactcagaacgtcgcatggttagctttcgtccgtctagcccttcgagataacccctctcggcttcctgcttaaccctctcaatcagtgcagcaagatcagggttagcctcaaggaactgggcccggagtctagccccgtctgccctggtgcctccaatgatagtcccaatcttggcatccccagcaccgtagatgaaggcgtagatgaacgtcttagcatcgtcccgtgtgggaagccctgcggctatctggttggccgtgtgtacatcaccctcgaccacctctttggtgtactctgggttgttgatgtaggatgcaagcatccgaagctctagaccagcaccatcgtagcccacgaataccaattgattcgctgggacgtatatcttgtgctttcctacaggcttccatttacctttcttgagttcctccacgatgttagtgaagggcctaaccctttcgttctccccaagatcacggcggaggacagtccatttccattcaccagcctcaggtgtcccctggaacaacccacggatttcaggtccgaaaggagaacgagcagcggggatattgactactacacggtgcctcatgcggcccgtaggtgttgcacaagggttagcactcccctctaggcgtccatcaggcctcacctgatctaccagcccctgcaagagggaccgacggtgtgcccaaaccattcgctgcatcaccagcttgcccaggtccccctggacggtatccatcgactcttcagtcatcttcggagtcgttaggaccttacgttgcttttcgagctttctcttgacttccccaatggtagttttcccagggatgatcccctggagcttcattcggagtcgtccagatttgctctgtcggagatcctcaatgtacttattcaaggattcattaaggtcagatccacgtagcttcttgccatcagtgccgacagtaatatccttgatattccattggtcaggtatccatccctgatccagcatccagtccttgaacttggcagtcttaccaaggtcgaagggtacatactcgattgcagagaagggaccagatacctcgaagtgcccaagacgttgccacagggactggagcctttggttcggcttaccactctttaggaatggcttgctgaaggccccagcccttacgatcatcatgggcatctgggggacagcctcaaggtcaatcttgaggattcgttcgctaagcacatggatcagccacttggcccgctgagtctggaagtagactccacgtttactctggcggctgatgatatcagctaccttgtgctcaacgaacagtgactttctccaatccacttaatcccccttaagacgctccgccagattctctacaactgtctccacagcttcgtgggatacaccctccaggtaggagaggtagtccacggtaccactgcggtccagcttccattgctgctccaggaaggccacagcaacttgcttgagcaggaagtcatctacccgctccatgaggatactcttgatcttgctcatgtaatcaccagtcgaaaatgaagtaggaacacccacgttcacaggccaggtctaccaggtaccaggacaggtcgatcttgcgctggatatccttaacgtcgctcagttcttcatcggatagctcgaacccatcaccccgcttctccttcaggtattgaaactcccatttcttctcttcttgggaggtaaacaagaggtctcgcggatctagctgggtattcctgtcgatgtagaagtcatcgtacaggctaagatccttctcccgtacccggctattgcgtttaggcgagtaggaactcagattcaggtgggagcctgagaagtagctcacccccaggaatccagcggggaggctcaggaatacccgacgcttttcccggagagtaatctggggactgctgaggaacttccggatgttagtcctttgtacctccatgctcttatgcagggcagaggccatattacacaggtacttaccacggacatgtttggaatagcttacatggtcactcatttgtatctcctataggggtaaagcaaccccggacaccttaaggttattataccacacttttctggatttgtcaagccttcttgtggaatactttatcgtaccacttgtagaagtattgagcagaagtaataccaagggcacctccccacccggacacgaagataaaccatccgatatccaagtgggaagaggccacggccttgatgtaagcaaactgagccagcgtgatacaccaagatactacaaacccagccttgatcttatcatcccgaaggagcttagagttcagacccaggaggaacacctggaagaatgcactccaaaagatgactaggacttgtagggttattgacatgactcacacacctcgggatctaggccacaggcactacccaaggggaagtcatcagcatcgatctcggggccaccccagctaccagagaactccttctccagggcaatctccttccgtgcctgatcctccaggctttccttcttactcgccatcgttaatctcctccacagaaacccatccacggacagccccaacctcgttggcccgtacggtcattggattggcatcggaatcacccaggaagaaccgaatgatatccagttctattcgatagaagtccgcagtgaacaccttggtgtcctggaaccccacgttaacccgatacttcttcattcttacctcccagaagctcttcgagattagccagtaccttctgggccttcaggttgtcctgcatgacctgggtacgctcagctttgagcaggctgatctcgttgtagatgcgctcagattcctccgaagactcttggatgaaggtcttcaggttcaccagaaccttgtcgaaggaactgaggatgttactgatgctaagctttcgattgaacatagtgagtcctcgggggcccgaaggcccctcttcatttactttttcttgcgaatgcctttggccttacgatcgcccacccgaccaccatcagcagcgttagaagaacggccacggacgcgaaggttagaatccccgttaccgccaccatctttaacacgtttgatatgatcgacaacctcgtcggctccgagcttccttccaagacgcttttccacctttcggcgggccctgtgccgctgagcatctccagacttagaccccacgcccgtttcgccgcgtcgaatagccagttccctttcacgcttgtagttcctcactcgctttttagccaatctacagtcctccattcaacaagctcttgccaagtcatgccgagtacccggaggaggtagttgaacagtgcgtgactgaccactccatcctgaaggcaatactcaaacatttcttcggagaacttggagaagtcgttaaagtcacccttgtgacacttcaggaacttaccccaggctcccagggaatgaccctggggcctatctggccaagtcaacctcgatgcaaccaaggtgtcatagcttcgatctgggggtatgataatcccatgaagtttctcaaggacccggttgtcgtagtcaaggatgttgtgaccgactacgaactttgcatgggcgatgatgcggtagaacacatccatttcctcgggccggaatccccggactaccccagtcggaatgtctacaacaacagcgcaccaaagccttgtgaccgtattgaagaggccgtccccctctaggtcatagataacgtaatcaaattggggtgtcatcgtcagcaggtacctcgtcgtaactgccctcacgttcaaccaagcgacccgtctctgggttatacttggtaaacactaggccagtgttaccgtagttcctgtccttgattacacggattcgactctcgtgcttctcttcaccgtcagcctgcttgttccgctcgaagccgatcataagctgacaccaacgctgcatagctcgggagccggtgaactggctttcctttacttcagcgccttcctcgtgggtacgattacccttgggcgggttaaggtgggagaagatgaagatccgaagacccagctcatcggccatacctgcaagctctgtacagatacgggcgatctccgtgttcatttcggaaggactaaggtggttggtcatggcggtcatgttatccagcaggatagtcttcacatccatggctactgcccagaagcgaatacattccttgatatgatcccaatcgttctgacccttgttcttccacatgaagagcttgccacggagtttacccgcagcgtctttaaaggcttgctcatcccactcgatatccggtcggtggaagggtacgttagctaccttccccgcgatattcttcagtgtcatggctacctgctcttccaacaggaatgtccctacgttctccccgtgctcaatgcaattccaggcagcaatctcgtgggccaacagggtcttaccgatgccagtacctccacctaccccgatgatctcaccatcacgctggccataggtaaggttggttagaccttcccagggatagctcttaccccacttagggggttctagcgcctcagcgtatacctcatcgacagttacggaacagtcaggagacttcaccttactaccgaatcggatcatctggtagacctcatccccccgattacgcatgagcatgtcgttagcatccttcagcgggagctcgacaaacttacactcagggtacagggcacgtaccttctctactgacttacgaccctcgtcatcagcatcatggcaatagatgacctcgttgaaccgttcgagtacaccagattcctttaggaatgcgatatctcgtccagcggaaccaacaccagaggaccagctaatggctgcctgacgcagatgcttccacttctcgggaagtttcgactccatgatctgggccacagacatagccgacagttcatcctcgcagatgactaaccgcaggtgtcccatatccttatgccgaagggtattatacccgaaggggtctacaccgcccttggggctaccacgatagtagaaagccttggggtctaggattcggacgttaaacgctcggtactccccatcgcgggtgcgtggatagtaatgctcgataacgtcctcaccattttcttgtgatagaccaacacgtaccccgtatcgttcagcgattgatttgcttatctttctagtatcgagggctttaattggatactcaaggacttcgttgacttcatggatgatatcctcttcggacttctcacttcgttcaggaaccttgaacccttcttcgagaacttcatagtggccgcaacggttacaactaccgaagcgggtacctttctctttgtctacgaacaagatgaggtgattacctgttttatccccacctttagctcggcaactcggacaggccgtatcaccgataatctgcttcacttattcctccatctggctcttgagcaccaagctaggtacagcattgacgttgcccggtagggtcttgtaaggagttgttacgaaagtaccgtagaccttctccagttcacggaggcggtcctcgatcttcttcagtcgctcccacatgaagcgaataccaacagattcgtcacagtacccaccatagctggtctctggactatccgaggcctccgggatcttggagacctcgatggaatcttggaggtgtcgttgggaggcgacaaggcccaggatctccttgaggagcatcttctgggcatgtagctcttggtgtccgaaggtgttcggggtatcgcggtagacttctactgctttgtctacggtcatttcattcattatactgccccttgtcgttttgccaggtgtgccttccagtcgccatcttggacgatatccatcgccatatggctatcctgatggtacaccagggccttgattcgttccccattgattcggaaatccttgagggtacgatcataccaacccggataaccctccagggcatccaggttctccagcatttcctcccccttctcgccttcggggagttgccagatttcacctacgatgagatcagcgcgggaggcaaaggagagtatggggaagccgccagcggagtacatcaggccccgctcgcaggatacagcattgccgacaaactcggccccttccagaaggtagtggttgtacaaaccagacaggagagtaccataaacgaaaacacgaacagccattagatagtctcctcgaagattttgttgaagcccttgacgtaggcctccagggcgctgccttctgcatccaggcccggcgcggtgttgatttccaggacaaacgcccggctagtggcatgctggaagatgatatctactgcaccgaagtccagtccagccacctggattgcctctgccgctgccgacatagcctgctcagcaccatcacggtccattgcatcgttaaccccgtatacccagccgccagctacgttacgaacgatgctttgtccttcgttggtcaccatttcattggcaacacggcggagcttgacttggagaagtactacttccccacggatcacatggactcggaactcggtacgcttaccgacgatgccctgggtgaacagttgtgccctggtaatcacttccgggatgtgggtgtgaccgtagatgtgtaccgggtagtggccttgacgtcgaaggttatcgattgcagtaacctcggcgtcgttgatcgaacacaccagatggataccacgaccgctatggccactcagatcagtacgtgcatacatacgaccagtgatattgaggacacccaaggcgtcttcccagcgctcggtccaacgaggaatcaagtggggagcattggcctcgaagtggcggaagaactccagtttgttagagcagcgggcaacaactgccgggtcattgaggaacaccggggcgataccctggaggcgtcgagcctctgcaccaacagttccccagttgataacggcagtacccgcacggccccgataggtagacccctcggaacgaaggattcgagcacccagggcgttacgaagggctacagcaccagcagaggggcgggcacctttatagatatagaacatggcaaatctcctgtttctgttgagggtagtagtgaagccagcaatagcccctgaggtcctaagttgaaccccatgtacacatcttaggaaccggcatgggtcggccaggggctattactaacgcactaccttactcgaagtagtcttcgaagagtcggtcgatagcttccgcaatgactaccggggccggtaccaggaattcctcgtccgggttggcatcattgagttcctgctccttgactcgacgaattgactggatcttgtccagggtgtcacgggagaagggatacttacgggttgcgtcggtctccatctggatcactacttgacgcttcatcgttacttgggtcattttgacctcctatttattttcgattacacactcgccacagatgaactcacactcatccaggctacctgtgaacttggcaccctcgtacaccgtcagatgacgattacgctggtcatatgcggttgggatcttcccgcaagatgcacacccctgagacacgaagtcccgaaagacatgcacgttgttgaaggtatggccttggaccttcagggggtaggtgatgttggccggaggggtgttccccgaggtgccgccgacttgaaccctgggtttagaatgggatttcgtctccgatgagatcgttccaatcctcaacactggggtagtctccccaggagtcggccgatgctttgggtccaggcagcttaccgccagatcctcgacagtaaccttgagatcacggtcttggccgatgaagtaggcattggagatactccctcggaggacggtgtatccgtggactttggcgacgttgatgccatgagcttcgatgagaaggttttcttcacgctcgattccagtgacagttccgtattcgctgccgtttgcgtaggcctcgatcttgacaacatcgaaggtgacaagctgccggtgcttgaaggtgctacctgctgcgtcgaggttgttgttgatccggagggtgttccttgcgtacgcatcgccagacgttccatacgacgagcccgcttggctgcctttcgttcccgcttggctgccttggcttcggctgtagtcatcgtagtccgagacaccgatgtagcgactccaccatgccgctgcttgcctttcgctttcggggatgggaaggtcgagaaatgtaaccggagtggtctggggttctgcaccctttcgcactccggcctccgtgaacgggatagttaccaggacttcagccttcagttcagcgatgggagaacgcaggcggatcttagcgttgggtcgctccaggaaaaccttgagcatcccaggctcagacgcccatacgatagtcccggtggtggtaaccgccatgaacagaggacgatcctcgttacggatgaagttcaggctacgttccttggagtcccaccagacaaccgcagcagcaccagagaacttctcctcgaacgtcttcttggcaccgtggttggcaatggtagcgcacagcatgttcgaatccacgttgtacttatcattgccatccagcaggtgcaggccccaggtatctacggtgccgttatgtaccatggtgatgtggtctacctggaaggggtgggcattcccatggtccgtcttgtcgcccatcgtggcgtaacggttgtgacctaggtagatgcgagcccgacccttgtccaggaactccttggtttcaggatcagccaggaagtcgtaggcatctactgcccgcttgtgaattcctacctcgttcttaaccgggtcgatcttggccaaaccggtggcgtgagcaccacggataatatccacggccaggagggatttgagaagagcgatttcgttatcactcgcgttagttgtggcacagaagcctaccaatccacacattgtatttctccttagtacatatatggttcgattgttacgccggtatggcgctgaaggtgctgcgggttatccatcagcagtacgaaggcatcttgaagaacctcttggtcctccagaaggtctcgtacacgcacttggtgaccaatacgacgcagagaggttaccgcagtgatcgctgtatccagtcgaacctgggtacctggcaccattgccaagttgtaccgctctgctgcaccatctagtagtcgtgaggtaatagcgcgagcaaagagcagcctatgatccaaagccctctgacgctcacgttcctgctcccggagacgacgctgacggttctgttcatcttccagaggatctaccccggagcgaacaaagcccatggttgctaccgcgagagtagcactggcgatccccatttcacgaccacccggagacatttcatagtccggagatacccccaggaagaatacatcacggagattcacctcggagagtaccttaaggaactcttccagcggggtttctgcgtgagccatggcgaaggccttgagacacaacatacgctgcatcaggcctaccatttcctgccgagtagtgagagcatgggccccacggaactcgatggacccgaagttgtgggttacctggaggttcaaggccgaatactttggccaggaggtaagacccaagactttctctcggtcaccttccggggccaggatacggcgaccgaaggtctgggccagccagtcgttgctgaagaacgggatgcagaagttactatcccgacgatacggttggcagtgatcgaagaaaacatcctcgaatgccatgtaggtcaggaccgttcgttcataaacaggccactctacgtcacgcatatccatgtgcaggtgggtggagcaacggaaggtgggggccggaggagtttcctccatcgcactcacaaaggattcaacccgagtgattgccttctggccagaggcgggaccagagaagacatactccataccatcccgcagagagccgtcacccttcagatcccacccgtccacttccggccagttgttgaggccttccagttcgacttcgaacccgaaggaagcaaccgcaggcagttcctcgtgatgttccggggcaatgatctggttcttacggaaccctatctgtgtgccaataactgacatagcaagtcctcctggttcttgaattgttcatctgcggacagtcggccatctaccatctgaccaaccttcacccccttccagtgaactaccccatccttgatgaagaagtcccggtgggatggggcagagatcatttcctcggcctgggtgaagattcggatcatcatttcgccagtgatggcctgttgggcatggttcagcaggatgttcctggggtccatacccttacgctgagtccgattgttcacgaggaaggatacataagtatcacgaaccccacggccaaagacgtcatagtacccactggagggccgcacgctttctacctcgctgtagacaaccccaccgtagtagttactgccgtcggggcgatacacattacccaggagacgaaacccgtcgaattgacggtcgtcaccaatggactcggtatcgtccacgtacactacccgaggctcgccgtcaacccggaagaaggcataggtggaggagtagtacatgttgaagtccccggccaaccgatggcgattattcaggtcattcatacttcacccccaaggcctgaagtgcagctaccgccgcagcgccgtcgttatcgttgatgattcgctggacttcatcgccagatacgatggacttgtactcctccaggaggtgcttggaggtgtaagcctgtactgccatttcatagacccactcggtcaggtctacagagaagatccagaagttcgacaggctacggtactctccgccgtagggcttatagcgcattgcaccagcctttccgtacagcttcttccgctgagtgtcaccgtcgaggatgacagacgccaggcccaggaggtagtcacacatctgcatgacttctcgggtggtagccttggtgactcgctcgatgtggctgaagccgatatggacgtggccgccagcagtgcgcagggtcggaggggcatccttcggcatcacgttctgacgacgagtccagcagttgtagtccggctcgcaaccgaagacgtaagcctggggaccgaagctgcggaggagttcctcgtcgtacaggtgagaggacaggttctcgatgatgttcatgccgaaggggtggagcatctgggcacccaggagtcgaacggagacgatacgctccacgaactcttccttggtactggccgggtcgatgttgtactccagaagaacgttgtcttcctggacagcaccaccggctacagccaagggctcttccttggtgccgccgatgaagccgatgacgctctgggggttacggtcgtagccgacgaaaacttcgggatctgcaccgatcagggggattgcgttgttcattgcatgttctccagtttttcgaggatttcggggatgctatattggctggtgggtacgacctcggacctttcccgacctggatcacctacgtcaatggtgattggggccatgatggaaaggattcggtcattaggtacaccttcgagaccgtcgcattcgatcaggcaatcatccttggtatacccctgccacaactcagcgtcgtgatgcttgagcttgtccttgaactcttcgcgagtccgctcatggatgctcttaatatcgaagtaggtgatattcttgtatccacctacgataccatccatgacctcgcttatgtagctgtcatccacctcccagccgtggctctcgcagccctccaggtattcaccagcagtcaccgggaacatggccgggtagctgtcgcaatgagcagtgctacctacctgggcacaagccgcgagggtgaggatctctgcattgcagcccaggattttatcacgattttcctgggtatagcgactcatggaatcacctacacaccacaagctatcgcccattcggagggcacagatgatggccgatgcgttcttcctgaggtctacccgtacatacactgcctgccggcggcctgggggattgaagtggtcgggatcactgaggttcttgaggtcatcgttgtaatcccaccaacgggtaggccagtcgatggaagccgagagaataccaccatcggtgatcctgttgaccaaatcactgttcaggaactccaccagtttaccagaggtattctcgtgggtagataccaacaggtggccaaccccggtaacccaccggtcgccaccaatcctggaggtctggtcgcaataggctccgaagcagtttgtatgttcggccattctcttgaccgagtagtggtgtacaacagaaccctcggcgtcatagtacacgttatgggctgcatacattcccatttgatttctccttggttgtcagaagtttttctcgatgaagtcttcgagggccagtaatatatcctttatgtcacgactccagccaatctcacccatgatccccagcttgaccactccgtgtttttcacagctactggtattaagccggatgaaccctcccacctcgctatctacggtcatgtagggatctttctttccgaagatggttggctgaggtgctatggtaactacctccaccttgtccaactgaatcttcaggaattcagacctccagggtgtgccccttacccactcacgtccacctggggcattccgattgggcatccaacgaccggatcggatagactcgtcagccgattggatgtggatatctcccttcttgagatcatcccaatcgctactgaacatgtagttggttaggggatacccggtgtagccattggctatcagtccgtggaaggacattgagaggtaggacttccagaagccatacttctcagcaagcttcaggtgaacctcctcttcacgaccttggtagtctagtccgctggatatcatcttgaagaggaacttcatgatggggtaccaggaatccagggtgtgtaccttggggttgaagtagataccgcagacaccttcctttccgtgatgggtgggggaaatcatttccgtcccgttagaatacttctcgaagggggaatccttggccttgctttcgtaagaccagaagtgaaccttcgggatcttgaaggccttgccgccgatggtgatggtcttgagttcaccttgggtacacttgttgagtacatcgatgaacttcttgcttcggcgggagcagatgaaggtccaaccgtcgagcttatagccgtgggttaccggaccttccattgtaccgaagcaggaggaagaggtcattaccttgagggctttaccctcgcccttcttgggtttcataccgaaggaatacttgatacgggccatttgttttctccttggttgagttagccagcaatacccccagggagttcctaggggcattactaacgccctcttagaaggggccgcgacgctgctgcttacccttgtggggcgcaggaaccttggtggccttgtagatgccgccattcagggtcagctcgccggaggttttcagtcgctcgtagaagactttggctttcataggctgtatccttgctggtgatgaggggagtaaggaaggccatgcacaggctgatgaagaggactaccatcaggaggtagtaaacccaatcatcatccggtggcctcttgggggatccagcgattgctgggatattgtagatcgcgtcgtatatgtccgaagttacctcactggtacggtaacaccggcggtgcccttgggtgcggtccccattgctgtccgtcatagtacatcagacctccaccgtgaaggtatggcccttgggaagtaattcgaagatatactctacccgccctggttgaatgtcccaactgttgccagtctccaggcatacgaagggaagcgtctcggtgtcaaggttcagtctgcctgacacgaagattcgaccaccccctcggtgacgccagaagtgggggactacttcttgggttgtacgaacctttacttcacttttcagtcccgccaattcatcacgaagttcctggatctccatctccattccgccgcactgatggcgagcatcatcacccttcgatgctgcgtcgagtgccatagccaacgacttctccaattcctggatcttggccgtggctacttccagacgcttagcgtactcgtcgcggtcatacataacctgcatgaacttctcgaaactgacgatgggtttctccgactcactcatcatccacccccaaagtcttgacctttttcgccagccgcttactgtagttgtacaggtacttcaagaagaagagcccatagaagatggatgcaaccatcagaccggcacccaaagcgctagccgaggttgaatccgaggtcatcaggtaggggaggacgaggaggtaaagaatccacagggggatagccaccagcatagtccgggtatacagcttgagcatttgatacctcacataataagtaagatataaaggtagaccttaagatatcctataggtataagagcaaccccggacaccttaaggttattataccacactttcagcagaatgtcaaggcctagatgttacagacctttacagagcttgtcgaggtattccgagtgctcgacagtaccggggaagtcctgcaaaccaccgagtcggcggatgaggacaccgtggttgatgaggatttctgccgcagcttgcacgttgatgacgtgaacccgaaccttcgtcgagtggttggcgctggaggcccaggggttgtagtggctgcccatgcggcggaggatggtatcggctaccacctgctcgttgttcacggagaacacggcggtgccatgaccttcgttgtactcgcgacggatgaccccgatcaattccttggcgaaaccacgggggctgaacccattggacgcaatgccggcgtagtggtcagcagtacccgaggggcccatgccaatgtaaatcttggcggtgcagcaggaggggaagtctttgcgttgcattagtaatctcctttgattagtcgtttggttgatccgatgagaataaccagcgggttgtagataacagccatgaagcacatccagggaagcgatgcaggccacagggcacccatcacgattgcaatgtcccggtctctctggcctacaattccattctggtcggctaaaaagagtgcggaaaccccggatatcaaaagggctaccgacatgtaggccaggatcgctgggattatcaggaggtatgtcatcatttgctgcgtaccaccttccgatgtacgtcaccgcagcgatcacacctcaggtcgtaatagtggcagagttccactaaccgatccttgtgacgaatctcgtatggtccaccatcaagtattttgtaccgatggacgcccaagagacaccaaagattaccgagatccatcaccagtccctcgcgcagttgcagcaacggccctctttgggaccgaagactggcatgcaatgggggcaaggctcaccggattggatcatagcctccctggcgtgccgcaggtaagccgatcggctggactccatacctacggcagccaaggtgaatccgagctcaacacggggctcctgggggccttcctgacgggtcatgttgaaccctcgtttctctactcgacgcttcattcgccgctcctgggccatgatttggccgatcattggtttactcttcatacggcccccacatcctggctgacacgtggacttccttcgctgggtagagttcaccatggttgtatatcacattggctgcgaagatggagaaaccaaccttggtgataatcgtcacggtcccgccttgtttgaggtagaccgaatctcccgtgaggcttacatacacaccatctttacgcttactgatgtgcaagtcgctacgtggctgggatactgctacggtgaaagtagtcatgggtcacctcagtggacccgatgaaccttgtggtccaccgggatgccgagttcgtaaagggtttcggtgatgaactggccgaagttgatgaccttcaggtggaattcaccatcgggacttgccaaccaatagatttgtggttcagtggatttcatagacgatacctgcacgtttgccgaagatagacacacggatatgtgtcacgtaccaactagggtacaccttggggttaggctggaacctgcggatgctgaccaaggactccaaccagaggaatagatacagggcgggcgtcatagtacacaccctaggccggagggccgaaccgatggacttcgatctctgcgtacttgacagtcacgggtaagaacccgcagttaacgtcgctgctgaagaatacatcgccattaggtccgccgaagatttcgcagatgaagaattcatcattaagctccaggtactggaagactttggggttcttcttcccggcatccactgcgaagatgtacaggcaacccggctcaaggtcattccacatcacaaccttgatcttactggtaatcatgttgtattggagtttcatgttacacctcgtagcaattcagctcggcagttactgggtataccagactcaccggcggcatgtaaatgacgttgccagtcttaaggttaacaacggcaacctcatcagattcacccttcatcttggtgctgcggagttcgcagaccatgtacacacccccattcatgaggaaggtttgggacttaaccagagaactgagggttactccgttgcggggccacaccttgatatccatggggctacctcacgatgcaaaaaggatgctgtccaaggtcgaggacaggacgaagagaaccacccacactaccagcaacaacccattggaacgtgagcgtatggcggcacatgcaatatacttccatgacattaccgcgccctgttcttagccagcgatgcccgcttggctcgcagccgattcagctccagggttttaccaaggtgattgccgctggagttggtcaactcacgagttaccttggcaatcttgcggtcgatagcctcgatggcttgcatgttgcggctaaccttgcgatagtcgttgcgtttcacgggttagtttcctttgttgatttcccaagacgccccagcctgcgaccataggtccggtgggggtttcggccaggaatcaccatggcctcatcagttgggtcagttgatacccattccttccttccagtcacggaagaagaagtatccgatgcctacacaagacaccacgatagcgatagtcatttcttcaacctcttaatcaattcctgttgttcttgcttccactttggatctgggtgaacccgcagcatcctcgtgagcttctgcaaccgattaaccatgagtgccctttcgtgggctgcttcgtagggggacttcatttgatccacccgcagacgctcagacggataccatccgtagagtatacaccgcaggcaattcctatttgcgtatcgcttcgccctcgatacctgcccacggtttaccatggacagatatcgatggatacgctgctggtgaggggtgcgcttagtagccttggggaagaaccaagcgccacccactactcgcatcaggccgcctcgccgttggggaacatctggcgcagcagggtattcagctgattcacttggtcagcagttaccttggactggtccttgaactcgctgtccagttccttgttgcagtccttgaccagccgcaggagccgtgcctgaagatcgatcggcttgaaattgtcagcggtttccgccgggccgcagtcggaccagtgggtgttcaggatgccggagaacaatgccaagtcttcttctgtttccccctggcgaacgcccttgtgctgcttgttgccgtcgaacttgaattcctttttcagttccgaccacttgaccggagcgtagcgctcgaagtagcggcgcaggctgttgttcttagcgcccttgggcatcatggccagcatcgcacggatcgcccgaacatcaccatgctcgtgagccagtacggtagccgatgctgccagttgctgggtcgcttcgttccaagccttgttgaacgacttcagagctaccagactagcggtgatctgatccttgccaaggattttgtctgcggtgagtacagttttcataagtatttccttttgtttcaggagttaatgagaatgtcaagggggttacgccccagacgtgggctaccaaagacagacttccggttgttgcgatggatatcagtcttagcagtcttgcgaccgcctttgtagactgcggtcctttgtttcggtttgcctttcactttaattccctctagaagatacattgcaaagggttattcctttgtaatatatcctacctaactccgaggttacttgtaagagggagcctgatggctatcgtagggagtaaccttacctgttaggtagggatgcgtcttgcccaaaggactctcgcataccagtcacgataagctagtagtagggattcggatggctacccttttgacccagcctttttcaatagtctaaccgccgttcctgggtccgcaatcaagcgggttatcctgggggattggttaaacctaagatactaggctgttgagtgatctagcttaaactatcggcattccccaatgcctgccctacctgggggcttgtatcgcaaccatcctagatggctggggattggtgcctatgttagagccttagacttggcttgtcaagtggtccgtctgcatttacgtggtggaccaatcctatcggctggagtcacagctttgtagttaggctataaacaaggcgccctatctacaccgccccggattagaacatccgctatgggtgcccatcgtaccgactgagccttaccttgtcaaccccggtcagctctcaactgtcgcggatcaacgtgctggcgtccttgtaccagctcaggggagattcagggttatacagcctcccggcccttgcgcctagccgctttgtcgctctaggttgtgacactgtactgcacttgctaccccttgtcaaccccagatgcctgccggccttatacttgggtgacttgggcgctcttccttagttggcagccccccggatagcactgcggcaagggggatggtggcttaggtagaacgtgggggccattagaaccggttccgcggggtttgtcaatcccctggggtttcccccgttgcctatcggtttccctcaaggcggcgccattacgccatattccctacggggttgtctactgttttttcatacagtctaaggactatcagtcccccagcaaacccccggatatagacagtctttgactaacatagggtatcgtgggatgtcaataggggatcaaggggttatcaatggatattccccccgatccaccccctgaataccctaagatttttcttatgaatacccttgggtccacccgatgaacggtatccctaggggttgatccccggactaacctcatggtatcctagggaggggctaggggctatacccctggggataggccacccccactttatctgggggactcctgggggg

SEQ ID NO: 4 - DNA, 66111 bp, artificial sequence
  BP1433
  misc_feature (28052)..(28052): n is a, c, g, or t
gttcgtttcgatgaagaaattatgccgttggtcagaatggaagtaaagtgtctggttgagaaaatttatgtaagccgacgaacggttatgctcgactgtctgctgcggtgtcgatatactcggcctattgcgaataatggactgattaagatgtataaactcaatcctgcactgcgagcggtctggcgaactcgcgcccgttacaaagtcatatatggcggccgggcgtcttcgaagtcgcacgacgctggcggtatagccgtttacctcgcggccaattacagactcaagttcctctgtgctcgccagttccagaaccgcatcagcgaatcggtctacacgttgatcaaggacaagattgagaattctgagtacaacggcgagttcattttcacgaagaactcgattaagcacaagaggaccggatcagaattcctattctatgggatcgcccgtaacctgtcggaaatcaagtctaccgagggcatcgacattctctggcttgaggaagctcactacctgacccaggagcagtgggaagtcatcgagccgaccatccggaaagagaactcagaaatctggatcatcttcaacccgaacgaagtaacagacttcgtttatcagaacttcgtggtgaagccacccaaagacgccttcgtcaagatgatcaactggaacgaaaatccgtttctcagtgagacgatgctcaaggtcattcacgaagcttatgagcgcgacaaggaccaggccgaacacatctatggaggcattccgaagacgggcggcgacaaatccgtcatcaatctcaagttcatcctcgcggccattgatgcccacaaaaaactcggctgggagccggccgggtctaagcgcatcggcttcgacgttgcggacgacggcgaggatgcgaacgccacgactctcatgcacggaaacgtcatcatggaagtggacgaatgggatggtctggaagatgagctgcttaagtcgtccagtcgcgtttacaatctggctaagatgaaaggcgcctcggtcacttatgactccatcggagtcggcgctcacgtcgggtcgaagttcgcagaattgaatgactccagcccagacttcaaacttacctatgatccattcaatgcaggcggcgctgtagataagcctgatgatatttacatgaagctgccgcacactactatcaagaacaaagatcactttagcaacatcaaggcgcaaaagtgggaagaagtcgcgacaaggttccggaagacttacgaggcggttgtccatggaaaggtttatccatttgacgaattgatttcgatcaactctgaaacgattcacccggacaaactaaatcagctgtgtatcgaactttcctcgccgcgcaaagacttggatatgaacggccgattcaaagtcgagtccaagaaggatatgcgcgagaagcgcaagatcaagtcgccgaacatcgctgattcggtgatcatgtcggccattctgccgatcaggaagcccaaaggtttcttcgacttctaaacacagaaaagcccggatcgctccgggcttcgggtcttactcggtgcggttcctggcgctgagtgtcgatgcaacggcctcgccgacttccagagctgcctggccggccgctagcgcttcgtcttccgactcgacgatgaagtcatcgccttggccgtcgccgggcggaacctctaccagcacggcttcttcgccctcgaaacgcaggtcatatgtcttctcgacggacaggccgtaacgtgcattgagagcatcccagagctgagcttcataggttcgaaggtcttgcagagatttctggtggctgagcatcgccatgtcgacggcccgttgcagggtttcgtccaggacgttgaatcgcatgcgaagagaacgaatacgctcgatcacttccgcatccaccacatgtctttcgatcatcgcttttcacctttgctgaatgttacgttatagccgttgtcggccaaataggtaagagcaccttcaaaggaagttccgacgaggtgcctgagctgcatttcgcgttgcgcggcgatccagaaggccgttccggagaactctgcgcggccttccgacagaacttttccatcaggcccgtcgattcgaacgtgaacggaagatagcttcagagccattagtgaatccctccactggcttgcgacggcattctttctgcgcgagcagctgcgcagtccgggcacggacaggactggcggacgcgctccaactcgtcggcgtccatgacatagagcttcccatcggaagtgtcgtgcgccatggcgatgttcgggaagtcggtggcgctcaggccggcgacagcgcggatttcgccccagagcgcttcattctcggcattcagacgagcggcgagcgcttcgtgctctttcgctacacgcgccatgaactcgtccatccggaatgcgaattccgcatcgatggcgcgggccgaggccatagagctgaggtgaatcggttctttcttcatggtaattctcttttggctggggtttgtggtctacccaggcctattcaaagcctggtcgttttgatgaagatgaacaagaagactgcaaacgccaatagcgttccagccaacataaatactgcaaatgccaatagcgttcctgagagcatgctcgcttgattctgcagctcagtgtactccttggttgacagcccttgctgcgccgcctcggccgcgaagcgggctttcgcctcgataacttccgggcgcagcgacaggacatattctaaggcctcttcccgcgctttttcggcctcgaccaacctagggtcgcgggccgagacttcgctgtgccctggcctcgcgggatgggcctgcagcgatggaggaagttcggcggccacgactccatagtcggagcaggcccaagcgatcccgatgaggatcgcgaggatggactggacgattcgcagcatcactttgtcgctaggaagactcatggttaatcctccaccgaccgaacgatttccatattgcgtccggcattggttccggcagcgtaggcgcgccgaccgtcactgtcttccagacgcatgagtttggtaacattcgacttcttgtaacccggatcgccgaaatgttcgtggaccgcagcttccttaaccaccaccagagacgttccggccgaagaaaccagctccatacgtttccgggtgatggatctgaggcgatagctgatttcctgggtcgcggcgagcttaaattgcgcggcgaccttgacgttgaaccgctcgaaaccttgagccttctgatattcccggcacagacggtctactgcctcgaccagggagttgaacatgttcaccgctagctcaacgtcagatttgtagcctttaaagcggacggcatggccccagcgcttggtggtgctgccgtcgcgagcgctcctggacgccttcgccgatgctcggtgattgttgatgccaccgacgaaatccatgatgcaatcattgtacgtcgccactgccacagagaagaacttcatccagttcgggattgcggaatagtagcgagtagcaatttgctcgtcgaattcttcgcgaatctcgccggtcacttcgaagtcgtgaaggtcatatttatccttcagcttcttcacgcgttctgccgcgatggcagcttcgtgcgggctggaagagtcggccgccatcgcagtcagcttgcgaatgcgatctttcgccttctcgatggcttcaggagtgaattcgttctggtcggtcatggtcggttccttttgtctgaaggtttcgcgtttcgatggagctattctgccttcatccagaatggaagtaaagcattttcttccactatttcggaagagcctggaaatagctccagatccaatcgcctgcggccaggacaacgatgagaactgcgaagaacacgactgcagagaccaattgtgcgccaggcttcagcttgggatggctgagtttgggctctaccggattcgccggagcgctggcgctgggcccggcgtcttcttgaccaaagccggcgccgcgctcgcgtgcctggatagacgctatggatttcaaatactcggtctgcttttgcgactcttcgtagatgccggcgacggcgaaccagagtgcgaacactacggccgtgcagacgacccaggctccggtcagaaggatggccagcggaccgatgaggaagacggaagccgccaggacgatggcgccgccccagatgatgaagccggccagaccattggtgatgtcgatacagaatttcttcattttttggttccttcggtcaagggatggatgggatttggaattcggcgcctccgaggacatcaatgacgacttcccagagcgtcggagccgaccactgataacggtcgaagtcggtttcgggatcgactcccagggttacataggaagtggccggccatttgtgaacggcgccttttcgcatgagagtggccacgcgaccgtcaccgagcggattcgtcctgtgaggaacataagccgacatcgaatattgctgtccagcaccaatgatgaattcttgcctctggcgcagacatacagagcctacaggctcccaaccgcgaccgccgcaggcctggcgagccgaagaatgctcatacccttcatgagtcaattcaccgagacgcgccgaacggtccacgtaataatttgtattctccatagacccaaccagaaccaaggactcgaaatcgaatcgatgatcgtggatggaagagtgatggaaacaaagccggcgcggcagctccggatgccacacatggaggcgcccggccgggagctggacctggatgaagcctaggccgtgcagcgtgattttgtccttcagcggatcagggacggtgtccatggataatcctcagtagcagaagtggatggtaaaggttacgatggccaagccggtcgcccataggagggcgaaccaggccatggctttgattgtaaggtggatcatccgaagaactttccggcgcagatggggccgatgcccatttcgatggatgcgtgattggtcaactcgcgaccgcagcaggagcattgaccagtcttccgaccgtaggcgactgccgattccattggcttttcgaacatcttcaggatatcgtcatgctctgtgtcggtacagtcgcggctcttgatgaatttgccgttagtgatccggccgaggtagatgtagcccaggacatacagactcccggcgttccggctgttggcgctagcctctttgaccacaacgatgagcggttcctcaccttcgccagccagacgcattttcgggcgcttgatgccagagtctttcgccttctcaaacgccttctcgattccggaaatgtccagagtcggcgcagcagcctcctgcgcggccactttctcgcgatgtttggcgaggttttcgatagctcgtttcgcagcagcgatctgattttcggtcaaggagccatatctgtaaagagaatccttaaggctctgggcaaaactgaaagagttgtcggtccaccactcgatgatgtccgggtgagcggcttcgaaagcctgaattttaaggccgcgatattgctcagccttctggattttctcgatgcgcttttctgccgccttagcacgactcttggcgcgttgctccgggctgctcttgtactctttatatccaacgccgccgcaggcaaagcaggcgcgaccataagacgaaggaccacggtacaggccggtgcctgcgcatttggggcacttttcgcgatacagcttcggttccttccaggagttcgggcgggcacccatggacacctcttccagggtcttcggcgcttcgttgttgacctctacggtagcgaagtcatcgcccaggtcttcgaagccgttgaacagattctctgctgcgttcatatcgattctcctgtttggaaagttcgtttcgatgggttgactatactccataaatggaaacgcggtagcactttcacgctaccgttcgtcgggttgctgacgatcaataaatgtcgctgctgatcttaaacccatgctcagcgccgtcgttgtagtcatactcagcatagctgtcgcagtagtcattcagatgctggatgattccaagaacgtcgttagcgaccccgtgacgcttcgcagcgatggtcttggcaatgctgtcgccgacttccagggtttcggcggtccggcgatggatcaacaaacggctccaaagatagagtcggacccggcgaatcatgtcgcgatggcgcctcagtcggctctgcagctcttcaatttcgaattcccgagacttgactactcgtcgaagctgctgaacttccaattccaaatcggccttagtagccatattcacctcagaaagggaaatcgtctgaggctccaggaagctcgacgattgttgttgatcctgagcggtcgaggatgcatccgaccgatcctgccctatggggataatgcctgcacgaaccgtaacaagtaacttctttgacgattcgccatgtcgatcctccacaccacctacatgctggtgggcgcttcgacttcagttttcgttcgtccaggacggctcgtctgtcgcaggaaaggcagcgagccttaaccgacgtaaccatgagtgtagtcgatcatgcgaatgagttcgtcatccaccgattctctcgacttcaaaccgttcaacgaatccgactggccgttgcaatttccattaatatccatggaagacagaaagcctgccgacaccactgtgatgtcaactttatcgccagccttcttgaagccttcgcattcggcgtcgagggccaccaacgcactcgcggccatgttgacgtgactgattaagtcggggaagattacgggaacttcacgagacattccccgtaccgtcatcttcatcactacatatttcatactcactatcctttttgtatgtgaggaaagaatttgctgttttccggatggtggaaacgctcggtcgcaggcggtctttcttccggacactgaatcgtcgaaggcgggaaaaccgcgctagagattatcgccgcgagcagcgcagcggatgtcgacatccacagggcagtttccagacttacccgcacttccggtcggctcggcttcattcgctccaaccccttcccggctcataagacgggatgctgccgccgcgaatccaactgtcccacatatggttcagaccagttggcggctggggcggcggactgtaaaagccgggaacttctgtactgctgaggaaataaggcgtgcaaacggcccgaacaaccagttgatgtcgctcccacatcttatcaatcgctcttagcatgacgtcttcgcactgagctttgctgtcgaaccgtctgctggtatgatccggcatctggacacagccatcgccagtacaaaggaaagcagtggcgatccatactgtgatgcttgccatttcgtcaccctctttggtagatgagcagattttattccatttgctcgtcagaagtaaagcgcttttcgtcgggataaatgccgatgatgtctgcgtcgagcatccaaatgtccacggacggatcgtcgctttcgatctgatacaggttgtacaactctttctcgtcacgcgccgattcgccgcgaggttcgacagccaagatacggccgtgcccttctccattctcatcgcgatacatgacgcgatccccgactctatagcagtctcttttaaagaggcgcgagcgcgagctgtttggcgattccactacccaggaatcaacaaccgcgtctttcacattactgtaccacttcgcagatttgtcgcagtcgaacacgcccagaacttcgccgtccttcaacacgatatgtacgataggaagaagaggattcatgttaatctccattggttgataattagagtctaatctgccgaaaagttcccgtaaagaattattttctcataactgattagttgcgactgttaatgtgatgtatatgtttgaatctcttttgaacgtttgatgtttcccctataataagcgcacacaaccagcaaccgcatggaactaaaatgtttaaactttcctggatattcgggcgcaaaaaggataatgctgcctgttctgaatcggcgccggagaaagtcgcacgaatccctcagcacgatccgctcgaccctatgattaagcttgggaagattcgcggctggaacgtcgagccggagaaagctccggtcatccgtagtgtgaaggattttctggagccgggtctatccgtcgcaatggacagtacgtatagtgacggacccaccccagccgcgaaagctgctgctggcggccagaacccctatgtagtcccgaccatgctgcaggactggtataactcccaaggattcatcggataccaagcttgcgccatcatttctcagcactggttggtggacaaagcttgctccatgtcgggcgaagacgccgcgcggaacggatgggaactcaagtcggacggccggaagctgtctgatgaacaaagcgcgctgatcgccaggcgcgacatggagttccgcatcaaagacaaccttgtcgagctgaatcgattcaagaacgttttcggcgttcgcatcgcgctattcgtagtggaatcagacgatcctgactactatgagaagccgttcaaccctgatggaatcacacccggctcttacaaaggtatctcccaggttgacccgtattgggcgatgccgcaattgactgcggcatctactgcagatccatctgccgagcacttttatgagccggatttctggatcatcagcgggaagaagtatcaccgcagccatctggtggtcgttcgcgggccgcagccgccagatatcctgaagccgacatatattttcggcggcataccgctgacccagcgcatatatgagcgagtatatgccgccgagcggactgcgaacgaagcgccgctgctagctatgtcgaagcgaaccagcactattcacgttgatgtggagaaggccattgcgaatgaggacgccttcaatgcccgtctggcgttctggatcgccaatcgagacaaccatggcgtgaaagtgattggcattgatgaaaccatggagcagttcgatacgaacctgtccgatttcgacagcgtcatcatgaatcaataccagttggtcgctgctatcgccaaaactccggccacgaaacttctcggcacttcccccaaaggattcaacgcgactggtgagcacgaaacgatttcttatcacgaagagttggagtccattcaggagcatatatttgacccgcttcttgagcgccactatctgctcctggcaaaatcggaatccatcgatgttcagctggaaatcgtctggaaccctgtggattccacaaccagccagcaacaagccgagctgaacaacaagaaagctgccactgatgaaatttacatcaactctggcgtcgtttctccggatgaagttcgcgagcgtctgcgtgatgatcctcgctccggctacaatcgacttaccgacgatcaggctgaaaccgagccgggcatgtctccagaaaacctggccgaattcgaaaaggccggtgcgcagtcggcgaaggcgaagggcgaggccgagcgagccgaagcccaagcgggcgccgtagagggcgcaggcgacccagttccggccgcgccacgcggtactaagcccctcgcgaaagcggccgaggaaggggccggcgaggccgctgcaccgccgtcgcggccgaaccccagggccgagcttcggaacctgctgtccgatctactgtcgaaactcgaagccctggacgacgcgcaagctccgaacggcgtggacatagagcaggatgacgcgccaggtctgaagcgaacgtcaaagccgagcgtatcgggtatggagccttcggtgttttcgtccaaccgcatcgtcggccctcgtgatcattctgaactccagaggatcaaggttaatggaatcactaccttgatcgaaaatccgcgcggaagcatccggcaagggaaggatgggagctggagagtccagatgaaacaccactatggattcatcaaaggtacgaagggggctgatggtgatgaggtcgattgcttcgtaggcccgaaccttggttcgaaacgggtcttcgtcgtcaaccaggtgaacaaagaggggcaattcgacgagcacaagtgcatgctcggcttcaacaacatcaacgacgccaaggctggatacctgtcttgcttccgtccgggctgggatggactcggctccatccatgaagttgatctgcccgccttccgtcgctggctggcaaacggcgacacgacgaagccatttggaggcaagtgatggcgttcaaagcctccaagaaacgcgaacgccgggcgcctcttccagtcggaagaggcaagcccataattccttctgctggaatcgaagcctggtatcgaaagcaaatgaaggacatggccagactcatgatcgccgattatcgaagtgaaatcgagaaggccatatcccagcctgcggcagaacggtttttcgcgaaagacgaatcggtgaacgtcctgttcaagatgactctgcgaagccttcagcagcgatggaatcgcatctttgaaggtttcgcggccaagatcgccccggagttcgtcaatcgggccgacgaagccgcgaccgctgcgactctacacagcctgtcggtggccggcgtcgatcagccgcgagcttcatacaatgagagcgtcaggaacaccctggaagccgcgactacttacaaccataccctcatcaccaacattcaagaggaagtccacgagaaaatttacacatctgtaatgttgtctctgacttccccaaacccagaggaacaaggaacttctggaataacaaatgcacttcgagaagtcggaaagttttctgaaaaccgaatcgaactcatcgcgagagatcaaaccagtaaactttacagttcgttgagcgatgagagaatggcagagaatggagtcgaagagttcgaatggatgcactcttcggcagggaagacgcctcgccatacccacctggaaaaggacgggaaaagattcaaactgaatgaccctagactttgggaaggtccaaaggccgaccaaggaccgccaggttgggcgattaactgccggtgcagaaaaatcccgatcatttagtcatcgataggagtgcgatatgccgttagtccatggaacttccaatgaagcccgttctgaaaacatcaagcgggagattgaagcagggaaagacccgaaacaggcagccgccatagcctattccgtccagcgcagcgagaaagagaagaaggcgaaagattgttcgcatgaactcgtcgctgatcttcgcgccctggtagactcgctgtcgaggctcgtgaaatgaaccgaaagacatgcatacgccgactcgcgaccgatgtgatcaaggccaatattaacggcggattcttcagcctgaagtttgccgcagttgatctggccatcatcggcgtctcaatcctgattgctttcggcggatgatgccgcgagaatccggattctgactaaaaattctggtccggatagccgcaaattaccgtttctgggaaatagcggtaatttggaaagcctactgccgcaaggctttaacaggctaaattcctaatttacgatttcgccgcatgccgcaaaagtatatagcatgggaaattaggaataacgttctaatagaattcatctataagtaacgttataatataacgttaatcgatatgctctatacgtattgaaattcaattttaatcggtaaattggtaatttggattagtttaaagattgaaagtcttgcggcagtaggcctagacaaatcccgtcaaatttccgaaaccaatttaccagttttcgcggctgaggaaatccggtaattaggtcacaatacagattctagtgtaaattaacagtcgcggctacatcgaattattgttccgcttatttacccttagatgtcctgcgtatataatacagccatagtccacgactcttcgaattaacgatggcaaagtcgaaaagaaaaattgacgaaaatggatatatgaccatcgagggctgtccaatcagctcttatggcattttccaatattctgccggtcaactcggtcttccgggcgatccgatgcggattgtcaacgtgtatcgtccggagtctgccgttagcgatcctgagtacatcgaatctctgaagaatctcccgctgatcgacgagcacgaaatgctgtcgggattcgacggcgatgacgatggcgtggctcccgaagacaaaggcgtggaaggcatcatcacagccaacgcctactacgaagctccatgggctcgcggcgatatccgcatctattctcgcaacatgcagaatcagctggaaaggggcaaggaagatctgtccctaggctatagttgccgctacactgagcaacccggcatctggaatggaacgccttatgaagtcgtccaggacaagatgcgcggcaaccacatcgccctggtaaaagagggtcgtgtgccgggggccagagtattggatggtctgtgctttgaccatctcagttttgatttcagaccatccgatgagggtaatgaaatgggtctcaagaaagccaagcagaagactcctgtccagcgcgcaggacaagctgctgattcggcggtcgaagagttgcgcgccctgtggccgaagctctctgcatctgtccagaagttcctgggcgaagaggcgcaggagccggagcatcaggaaggcgcaaccgctccggccgaaccgaccgacagcgagcacatgaccgagcatccgactctggaaggcgctcaggaagacgacgaagagcacgaagaagcgccgtccgttgtcgatccggccgtggtcgccgtcgagccggaacagcaagaaggtgccgcatccgaaatgtccggtgaaggcgaagtcgccgaactgatctcccaggtcaaggccattctggctcgactggaaggcacggtagccgaagaggcggacgaagaacatggcgaaggtcaagatgtcgtcgagggcttggaagaacagagcatcctctgcggcgcgcaaaccgccagcgacgatggtggtgagggcaaggataacagcgaggaacttcctgaaatggcacaaaagaacgcgcaagatgctgcaattcgtggtctctatcgcgacattgctgctaaagatcgcctctacaagcgtcttagttccgtggttggtgcgttcgaccaccgagctatggactcggctgaagtcgctgtttacggcgtgaagaagctggcgatcagctgtgagaagggccaggaagttctggcgctcgacatgtacctgaaaggcgtcgaagctgctcgtggcgcggccagccgtcaatcgaaagcccaggattcggccagttctgctccgcagtgcgccgagctggacagttacctgaagggggagtaacccatgttccagaaacaagtctatcgccagtacactcctggttttcctggtgatctgatcgaggacggcccgaagcgtgcgcggccgggtcggatcatggcgttggcatcggtcactccggccgcgactgccaccggccccaaccgcatcagtcgcgcgtttggttacgcaggtgatgtcggttccctcggtgaaggccagccgaagaccgttgccgcgcgcgcttctgaagtcgtggtcggcggtgcgaccttcttcggaatcctcggtcacccgaagcattatgctctgtacgggtcggccggcgattccctggctcccagctatgacctgcccgacggttccgaaggcgagttcttcgacatggccaccggcctggtcgtcgaaatcttcaacggcgcagaagccgctctggatttgagctacggcgatccggtggcatatgtaccgaacaacctgcctaccaccgacaatgccctgggcctgccggctggcgccctggtcggtttcaaggccggcgccatgccaaccggcctggttcaaatccccaacgcgcgtatcgtcaatgccatcagcctgcctgcccagtcggcgggaaacctggtagctggcgttaccatcgtccagctcacgcagtaaggaggcgtcatgagccatatcagtaagacccattcgcgcctcgcaggccgtcacgcaaaaccattcgacctgaagaacgtcacccacgaagccgtggccgccctgagtcgcatcggcctggtattcgatcacgccgtcgtccaggaccagatcaaggccttggcgaaggccggcgcattccgttccggctcggccatggacagcaacttcaccgccccggtgaccacgccgtccatcccgacccccatccagttccttcagacctggttgcctgggttcgtgaaggtcatgaccgccgcgcggaaaatcgatgagatcatcggcatcgacaccgttggctcctgggaagaccaggaaatcgttcagggtatcgttgagccggccggcactgcggtggaatacggtgaccacaccaacatcccgctgaccagctggaacgccaacttcgagcgccgcaccatcgttcgtggtgagctgggtctgctcgtgggtactctggaagagggccgcgcttcggccattcgcctgaacagcgcagaggccaagcgtcagcaggcggccatcggtctggaaatcttccgcaacgccatcggtttttacggctggcagagcggcctgggcaaccgcacctatggtttcctgaatgaccccaacctgccgccattccagactccgccgagccagggctgggccactgccgactgggcaggcatcatcggagatatccgtgaggccgtccgccagctgcgcatccagagccaagaccagatcgacccgaaggccgagaagatcaccatggccctggccaccagcaaagtggactacctgtcggtgaccacgccttacggcatttcggtttctgactggatcgaacagacctatccgaagatgcggatcgtgtcggctccggagctgtccggcgtccagatgcaggaccaaacgccggaagacgccctggtcctcttcgtcgaagaagtggacgcgtccgtcgatggcagcaccgatggcggcagcgtgttcagccagctggttcagagcaagttcatcacccttggcgtcgaaaagcgggcgaagtcgtatgtggaggatttctccaacggcactgccggtgctctttgcaaacgcccttgggctgtggtgcgctacctcggcatctaaccgatgctgactcaccaaaggccgggcttccggcctttgttcactctgactctgactctgactcggttgtaggggccggttagggcataattaataggactacgccaatgactgtttacatcgtttccgcaatgactcaatccgtgtcttacaatgcgtatgacacctctgatccgtccaaccctcgtctccagagaaaggtgctgattcgcggccgcgctggcattgcatccgaaacatccggcttcggcgacatgatttccgacgcatccgggcgcccgatctggacgccgcagggcgattgcacggcggtgagcgattccgatttcgaactgctccagaccaacaaaatcttcatgcggcacatggagaaaggttatctgcgagtcgtgaaaaccgacatcaccaatgaccaccagcggattgcgaaagagactcgcaccatggagcgtgatggttttcagcctctggattctgctcgcctgaagcagaagattaaagtgactactgccagcgcttcccaggaacaagagttccgggtttaaccgagggtttcggtatggtgattttcgacgagcaaaagtttcgcacgctttttccggagtttgctgacccagcgtcctatccggctgtgcgcctgcaactgtatttcgacattgcgtgcgaattcatttctgatcgggattctccataccgaattctcaatggcaaagccttggaggcctgtctgtatctgctgacggcccacctcctttcgctgtcgacgatgcaagttcagggcgcggccggtggcggggtcacggcaggcgggactcaaggcggtttcatcactagcgctacggtcggcgaggtcagcgttgccaagctcgcgccccctgccaagaacggttggcagtggtggctttccgggacgccttacggtcaggaactgtgggcgctcctgagtgtcaaggcagttggcggattctacatcggcggccttccagaacgtcgaggattccgtaaggttggagggacgttctggtgatccctggagcgaatctgctgcgtatggcatttagcgtcataggaacgcagctcgttcagtatcgcaaattcgagcagaggacgaagaatagccaggcgcagtacgtttctgtgtttggcgagccattccaattggccgcttccatccaaagggttcgtcgcgatcagtatgtccagttcaatctggagtttcaacgaaattacgtcatgatcttcgccaactttgagatggttgacttggatcgagatttggccggcgaccagttcatctggaccggaagagtttttcaactagagtctcaaggctcttggttttatcaggacggctggggagtctgcttagccgtggatatcggtacagccaaactagctgaagacggaaccctgactttctaggtggcttatgttcgacggcgaactgatagaaaaattggtggtcgagcttacttccgccatgacgtcagccaaagaaactttgcagtttcctgattttgaggttgtgcagaaagcccagccgacccaacagggcacgtcaaccaagcctaccatcttcttccagaagctgtttgacatccctcgcggctggccggcaaccgattggtatctggacaacgtcgccagaaaatatgtagaaattactcgacagcatgtcgagacgacttttcagataagttcccttcattggcagaatcctgagctggatcacgtagtcacggcagccgatatcgccaattacgtgagagcttatttccaggctcggtccaccattcagcgagtaaaggaactggacttccttatccttcgcgtgtctcagatatccaacgaggcattcgaaaatgacaatcatcagttcgaattccacccaagttttgacgtggttgtaacttacaatcagtatattcgtctgcacgaaaacgcagcatattcagccgatggggcgctgataggcatatgagcctgagacgcgattcagaactgatcgccgcgcacctgcagatgttaagagccatgcgcggcaggtccgtttcggccggatggtattccaccgctcgatatcctgataaggcgggcggatcggtcggaatacaagtcgcgagaatcgcgcgcctcaatgagtacggcggaactatcgaccatccgggcgggaccaggtatattagggacgccattgttcggggtcggtttgttggcgttcggttcgtcagaaacgattttccgggagaaaccgaggtaacaaaacctcacaggattgcaatcccggctcgaccgtttatgcgatatgcttggaacttattttccgcagatcgcgccgcaatccagaatcgaatagccatgaggctggccagaggacaaatcacgccggatcaagcgcttgcccagatcggcctggcgttggaaggatacatagccagaagcataaggaccgggccatgggtggctaactcagcatctacggtcaggagaaagggtttcaacagaccgctggtcgatacggctcacatgctccagtcgattagcagcagagtaacataaaccaggagatcatccagtgatcagtcagagccgttatatccggatcatttccggcgtaggcgcaggcgctccggtcgcaggccgaaagctgattctgcgcgtcatgaccaccaacaacgtcattccgcctggaatcgtcatcgagttcgacaatgccaacgcggtgatgtcttacttcggcgcccagtctgaagaataccagcgcgctgcggcctacttcaagttcatcagcaagagcgtcaattccccgtccagcatcagcttcgctcgctgggtcaacaccgccatcgcgccgatggtagttggcgacaacctgccgaagaccatcgccgatttcgccggcttttccgcaggcgttctgaccatcatggtcggcgcgtctgagcagaacatcacggccatcgatacgtccgccgcgacctccatggacaacgtggcgtcgatcattcagaccgaaatccgcaagaataccgatccgcagttggcccaagccaccgtcacctggaatcccaacaccaaccagttcaccttggtcggcgctaccatcggcaccggcgttctggccgtggcgaaatcggccgatccgcaggacatgtccaccgccctcggctggtccacctccaacgtcgtgaacgtcgccggtcaggctgccgacctcccagacgcggccgtggccaagagcaccaatgtcagcaacaacttcggctcgttcctgttcgccggggcgaccctcgacaacgatcagatcaaggccgtgtcggcctggaacgcggctcagaacaaccagttcatctatacggttgcgacctctctggcgaatctcggcgctcttttcgacttggtgaagggcaactccggaaccgcgctgaacgttctgtctgcgactgcctccaacgacttcgttgagcagtgccccagcgaaatcctggccgccaccaactatgacgagccgggcgcttcgcagaactacatgtactatcagttccctggccgcaacatcaccgtgtccgacgataccgttgcgaacaccgtcgacaagagccggggcaactacatcggcgtcacccaggccaacggccaacagctcgcgttctaccagcgcggcattctgtgcggcggtccgaccgatgcggtggacatgaacgtctacgccaacgaaatctggctgaagtccgccatcgcccaggcccttctggatctgttcttgaacgtgaacgccgttccggccagcatggtcggcgaagcgatgactctggccgtcctccagccggttctggacaaggcgacttccaacggcactttcacctatggcaaggacatcagcgccgtccaacagcagtatatcacccaaatcaccggtgatcgtcgcgcctggcgtcaagtccaaaccttgggttattggatcaacatcaccttctccagctataccaacagcaacaccggcttgaccgagtggaaggccaactacaccctgatctattcgaagggcgacgcaatccgcttcgtcgaaggatcggatgtaatgatctaacggtttgcggcggactcgaccgccgcaaccttccatgaatggagtgaggaataagcaatgatcaacatttctgcgttcggctcgattgcccaattcacggcaagcagaaccttcccgaacggattcacagtgaccgagttcgctgatgatgcggaccccatcgacagcccgccgttcactgcggctgataccggcgtcggcctcaatggcgatatggtggtttggaaccgggccaacatcctggaagtcgtcgtcaacgtcatcccgaacaccgagggtgagcgcaacttggccgtcctgctggatgccaaccgcaccggaaaagacaagtcgggtgctcgtgatgtcatcggtctggtcgtggcgatgccggacggtagcaaaatcacctgtaccaacggcactcccatcgacggcgttctgatcaatgcggtggcgagcgttggccgcctgaagacgaagccgtatcgattccgtttcgagaaagtggtcaaagccggtactagctgatgaagaagattccgctgacagcagtcccgaatcaggcgatctcatttaacgccggcagcagctattggaagattcgtctgtaccagaatctggatatgatgaatgccgatatcagccgcgacggcgtgatcgtttgtcatggggtccgctgcttcggcggaattccgcttctccagtatagccaccagtatcgacccgactatggcaatttcgttttcgaccgtgacgccgattggacgttgttcggcgacggcataaacctgttctatctggacggtgtcgagttcgcagaatatcaggcgctggccacgaggaaagaatgagcacatcaacgatcagaaccggggcgaacaatgatatccttttggacgacaatggaaacatggtcattctcagggatgtagaagcgtgcgcccaggacgttcgggcggcgatgctcatgcgcaccggcgaaaacattttcgatgtggacgccggtgtgggatattttgaatatatcttctcgccgcagaagagctatgatgacgctcgcaaatccatcgcggatgcaattttgtcatcgccggacgtgaccggcatcgagcaacttgacatcgacatcaccggtgaagtcttcggcgtcgatgcgaaagtcatcaccatccacgggcctgtaactgcaggagtttgaaatgagtaccatccgcatccaatacgccaacggcacccaactattcttggacggcaaaaacccgccgctcctggacccgcttccttctttcaacccgtcggtcgaagacctggaaggcctggaccgcgaaaagaacactggcaagggcaactcttcgtcggccggtattcccgttcccccggtgaacgtcgatccgaatgtcgacaacggcggtgccatcccagctccggcatcgaccggcgcccctgcggccggatcgaccccggaaagcgcccaggaagcccctgcagagggccaaggcgacgagaaagggtccgagacgcccccgactactaccaaggaagaaaagaccgaggtagaggcctctgcggccgctaaagaggccaccgccactaccaagcccacggctcgcaaaaccaccagcaagtaaggactcgacatgatcaacgtcagcggcttcggcacaaaggsgargaaaaggggcccgagccccccccgactacaaamaaaaaaaaaaagvccggggwagrggcccccggggcccraaaaagagcccaccgccactaccaagcccacggctcgcaaaaccaccagcaagtaaggactcgacatgatcaacgtcagcggcttcggcacgggaattgtgatagtttcaacctcgtcgttcccgatggggttttccttgtcgaagttcgctgatgatgagagtccgatatcatccaaagagctggagccgttcgggtatgagatgctttatgatggcggtctgtttgccttcgataaggcggcccctttggaagtgtccatatccgtaatcgcagggagcgaagatgatattaatcttcgcatccttctaaattccaaaaagggatcatttcgattccttccaggcgtcattccagacatgacgactcttgttgcaactcttcccgatggcggccgcactgttctgtccaacggaactatcatcaagggtccggccatagataccatccagaacaccggacggcgcaaaggcaacacgtatacttttgttttcggcaactatctcggcgcccagactgcgcgtcaagctatttctaacgttattcaatcggttctggaggtgatctgatgttagggattttcaccagcctcctaagctcgcggtctttttcgattgtagatcagaatacaaaccagctagttgctgcggatttgaggataagccgggttaacacccggttttcttctgtagggcagcgccacatgctggaagacggtacgacaaagatggactccagaacggtccatcctatggagataatcgttgaggtattctgcccttcaattgatgtcgtagatcagattaatcaactgctcctggatcgtgatacgctgtacaaagtcatcactcgcggcatggtattcgaacggatgatgtgtaccagcgaagcgcttaatcagacgccagaaatgatatcggcaactcctgcgcggctgacattttcccaagtgctcgttcagaatcccaaaccaatcatgttcaggaatgctggagactcttccataatcgaccgagggttggccctggccgaagacgttgtgggctcggccagtgacctgttcgactacgcagtgaacggcgtccagaacgccgcagacttgttctgaggtgccaattgaactctttcctcaaggccattctcaacacgcctactctcaccatccgtgatgatgtaaccaaacttcccgtttggaagagtctccaagtcaagaaagtggaaatttactcaccggcttccgtagtgtcgaagcctttggcgacgaaagaccagacggaagctcaggtgtataccgaagcgctggacgttgatgtaaagaacgggaagatcattcagccagtgcggcttcgcatcaatgccatctgtccagacttgtccacagttgaaagtatcatgaatgctttcaatgacaatacctcgactttcgccatcacttccaagtcgatattggctgataaaatggccatcatgacgctcgatgtagatcaatctcctgacatgctaaatgcggctgagatcaacatggaattcgagcaggttgagcctccagtattgaatgaatttgatccggctttccctcaagatcgcccaacttatggcgtgcagattcagtccctttccgatgcaaatttgctagacttgggagccaccggcgattcgatatcttcggccgcaaaatcgctatataatcgcgtgaccagttatttctgaggatgtatcatgcttgaaatcaaccttcccgatggccgccaaactcgcgtacaaatcgaggcgtggtcggcattggacggctgggaactccagcgccgtttcgtcgagttcgcagtcagcaaggatgccgacttccgccgcgctttcaccatggaaatcctgagctatgccaaagtcattctcggtaacgatgattccgaaattccgttgactactgctgcggtcatcaacaaccacctcggcaactggaagaacgttgaattcgtcttcgattccgtcctcaagcacaacggcatcgatccgacaacgcacgccgaccgcccggactattgggagcaagccggttcgcagatggcaatcgcatttctggccgaggcgtccaagctcattgggccagctatgaaaatcgccgaaggactcgccagcaagccggagtaattcatgtctagtgatttggatgaattcatacttcggtatgaggccgacacggccagagccgaacgaaatctggaacgtctccagaatcagatcaggcgcgtaaacagcgcatcgactagtggccttcaagatttgcgccacttcgcagacggcgctgcaaccgaactcggccgcgtggttccgcaggtggacgccgtaacgagcgcgattcgcgggatgaacgcccagctcgcgataggcgctactggcgtggccctggtcgcggccggcgtcaaggcgttcatgaacaccagggaccagtacaaccagcagcgcatccaggcgatggatatcggcatcgccccggcgcggctggaagagtaccagcggaaactggcccgccagtctggaggaacgatcagccgcgagcagggcgcggaaatgaccaaaaatctggccgacactttccggcgagcttatcgcgatatcggacgggtcggcccagaggcgcggattctgcgcatggccggcgtagatgtcggaagcttccagaaaggcatgaggccgctcaacgacatcatcactgagtttgccacgaagatggccaagttgaaaccggacgagatttcggcatatgctgatgccctcggcgtctcgcgggactatctgagcaccctggcgaagatcggcccggcaatgggcaaagtcactgagatgacgtcagaagagcttcaggctagggtcaggggcgagtcaaacattcagaagttcaatgatgctttggcaaacctcaaccaaacgttcacgactctggaaaaccgcgttggcgaaaaactcgcgcctgcattcaccaagttgatcgaaatcatcgacaaaattgtccaggccattcccaatgaagtggaagaattcgccaaggacacgaaagcccgctgggacgatggaatcaccggaaaggccactgtgggcggcgatatcctgtcccttctcagccctggtgctctgctaggtcgtctggcctcctggggcactcggcgcggcatggaagaggccggattaatcgacaagtcaaaggtcccaggctcccaaggccaaaccagcgaagacctggccaagaaacaggaagaccaggacaaagctacgaagtccatgaaagaactggagaaattggccgaccagactacgaagtcaacgaatgatttcgcggtggcgatcaacatgttcagcggagccgtgtcatcgttcgccaatgccgttgacgagcgtcaagcatgggcggcatgggcgggggaaatcgggcgcgcagtgggcatgggaagcaccgcaccgacttcgcgagcaacaggggtttatccgcacgcgatctacgatcagtcgaagagtggcgcggccggtcaagtattcggcgagcctattggcgcccagtctctgcgaaacaggatgttctcgccgcagcgcaaggccgagccgatcaacgtgccatcgcacatcgatgacatcatcaaagatgcatctaagatgtacaacattcctgagatggacatcaagaagctcatatacactgaaagccgattcaacgctagggcgaccagcgaagccggggcgaaaggcctcatgcagctgatgccggaaattgccaaggcgtatggaatcaccgatgtgtatgacccacgccaaaacatcctcggtggaacgcgcctattgcgggaaaacctggaccgggccaaaggcgacatgcgattggcgttgacctactaccatggcggcctcgacccgaagaactgggggccaaggactcgcgcatatcctggtttggtgatgagcgcaccaattgaactgatggaggaagcccagcgcaagcagaaggctgcggccatgacggtcgccaacgagacgttcgcgccagaaggtggcgacatggacattcgcccctatgacggcggaaggctggaagctccggaccagggcaggaaggaggatgatcgccgcgaagctcgtcgatatgacgacagagttgtccggccggagattcgcatcatcgaccgcatgccagaccgcagtgacggcgaaattcttaaaatgtctcagcgccaagacgccgaccgggcggactctggattccggaaattcccgaaccaggttcgtggcgagacaaagcagaacatccaggcccaactcactgccggagctattgcccaagtcatcggtgttaatcctaaccaaattatgcgccgcgaaatcagccgttccgacttgctgttcggatacaaccaggccatcttgggcaaacagcaggaaatcaaagccgctgcgacagaggccaacaatgtattcctctctccagccaaactcgctgaggctactgccaaggtgaacgccgcatcgcgagaaatggatattctcaggacgtatggtgagaaacttctgaagagcgctccagagcgcggccaggaactgacaatcggtcgaattgatatgttggtcaacgtcaccggcgcgaattctccagaagaggctcgcgaaatcttcagcaggcaaaccgcagaacagctgactactgccatccaggactcccaaaacgattccgcaactaagatactctactgatgaaaaagagaattctgcgagtcacgttcaatatgccctatggacccgaaatcatccgtgaagacctggatgttcgggtacggattatgaaggctgcattgcgaattcaaaaccgagctaccctggaaatctttggcctcacgacgcaattgcgcgagtctcttctgtcgcagttcacagcgtggaagcaccggcagcgccaagtcggaatggaagacgagctgatgatcagagtatcggttgaggccggttattccgatcagggccgcgaacaagtttccagagtatttgtcggcgaagtggcaattgtcgatgtcatttcgccgccaccggatattggaattcgcatccaatgctacacaaggcaaatcgataggacgaagactattcgaaatatgccgccagccaacacgacgtttgtaaagttcgtcgaatggggcgcaaatgaaatggggcttaacttcatctgcgataccagttacaatgatcaagttttgaagaatccgggccggtcgatcactgtcgcgtcggcaatcctggcatcgattcaggatatgtacatgccggatgtggccgcgttcgtcgatgatgacattctggtcgtgaaggaccgggataaggtcattcgtcctgatgaagttgccaacatcaactcattcgtcggcatcccttcatggtcggaatggggcgtggaatttcagtgcctgtttgaaccgtcgattcgcgtggctggcggtgtcgcggtcgaatctctcatgaatccaagcgtcaacggcaactatgtgatcaccgctctagagtatgatttggccagccgggatcggccgttctatatcaaagtcatggggagcccagcagcgtaatggccagggaaatcaaatcattcaatatgttcggcgtgcactacaactcgcggcaattctctgcggtcgatggactcaggatgatgtcgggaatccatgatgttcctccggaagaattgctcaaagggaccgacgtgttggcccatacggaggaacaaccggaaggcgtttggcttcccttgaccgctgcgaacataaatctttatgtaattgaccgggcgaacgtaatagctcccgtacaagtgcttgcgcttttgtctgaactggtcatagattggaactttggcttcctcaaagattggacaggggtcaaaattccatcaagatttgtagaagatatcaaaagcgtgaagacggcccattcgccttccgtggtcgcaagtttggtggcgaatgggtcagcttctatgcgcgagctggaagagtattattcgactcaagatgcctttaagatgattgacatcatgactgcgaagagcgtgaatgaggctctagcgtccgaagcatcacagaacagaatcaaaaagggataattcctaagcgagcctgggaaggctatactagaccggccaaatcagaggctttcccatgtccaatattccgctaacatccgcaaaatctaccgacagaacgcgactgatcgccgctcttgacgctcggtcgcggcgggatgcgctcgactttgaagtcatgattcccgcccaggttgttcaatatgatcgggcagaaaacatcgctaccattcaacctctcatcacctgggttgatacggaacacaatgccgtccagcggcatcagctggttgacatcccggtgatttccatgggcgctggcggcttccacataagtttcccgatccagcagggggatatcggctggatttacgcggccgaccgcgatacttcccagttcttggagtcgctatcgatgtcgaagccgaacaccggccgcatccacaaatttgaacatggtatgttcataccggacgtattccgccgatacaccatcaattctgaagactcggacgcgatggtcatccaatctactagtggagcgaccaggatttccattcgcggcgacaacatcaagatcactgcgccgtcgaatgtaacagtggatactccgcaggcgaatttcactggaaatgtgactatcgccaacaccctggttgtaaacggcgtcaacgtgaacaaccacggccacctcgaaaacaatccgcctgatgcccggactaaaggcggcatgattgcctaaggagaatttcatggctagttttgatttttctgatttaacagcgggggggggnttgtaatggctaattatgactacatagtagatactggagtcatagtcgccgatactgctgatattctgaaggacgttgaagcggaattcatggcagccctcggcgccaatatcaacctggcggcctcaacgccccagggaactctggtcgcggctgaaaccattgcgcgttctagcgtgatgaggaatgaagctcgcatcgccaataccatcaacccaaacgtgtctttcggaacgttcctggacgccatctgtgcgctgatgggaatcgagcgcggctctgatctttcgacgttcggctatggcgtccaggtgaccggccgcagccagacccgaatttccaccgggtcgcgtgtgcagactccggccggagcgattttcacggtcatgagtgacgttctgattccggcaaccggagtcgccaccatcgacgtaaaatcgcaggactatggaaacatccctcttcccgtaggaaatcttatcatcatcgatggaaccatcggttgggccggggcgaaagtcatcgcttcaactcgcgtcgatcctggcagccgccaaatgaccgatgcagaattgaagaatgctcgcgtcaatcgtctggcgatccaaggccgcaactcgactttggccattaaagcgtatgtcagcgccgtgcccaacgttacctcggtcaacgtcatcgaaaacaacaccggcactgttcaagttgtcaacggcgtatcattcacccttccgtatgcggtctgggtctgcgtcgccggaaatccggataagcaggctgtcgcagatgctctgtgggcggcccacaacggcgggactccctgggactatggcgcggccgacaacggcgtccctgtggatgggcctactggcgttcctgttcgcgatccggcatctggtcggaagtatgtggtgaagtggactactccgatcatgtatgacggatatgtaaacgtcaccgttcagcaaggctcttcctcggttgctccggaagcaatccaaaacgcagttgtaaattacgcccaggggaaagtggagggcgaagagggattggtcgtcggcgcgagtctgtctgcctttgaagtggccggggccatcgctcgcgagattcccggaatctacattaaactatgccaggtggcttgcgtcccggctggatcgccggccccggcccccggcgacttctcgcctgagtacgtcatgagcgcattcggtcaggctaccatttcggttggcaacgttagggtgactttcgtatgactctgcccgcgtacaattctgatattcaacaggcgctgaagtggctccataaccaggcccctgggatcaccggcttggttcagcgaaaagctcaatggtatgaccgtttcagtcgtcagttttgggtcaactgggagcgcgacgttttcaacctgaagaccgccaacccgttcggcctcatggtgtggtgcatcatcctcggcacgccgtcgaaaggattcggcctatatccaaaaaacagttcttgggcattcggtcggctacgccagaacttcatctatagcggtacacaagttccgccaccggcagacgcatcgccgggcggcaacttctacggtggcggcaatgccgaaattctcaacttggacgaaatcaggaaagtgcttcagctaagatatgtagcgctgatttcgaacggctcgattgcatatatcaatcgcatgcttcgctacatattcaatgatgatgagccgtgggacgaggcgaccggtctgtacttctatctcatggactcaaccggcgaggatggccctgtggagaacttggccatatatcggaaagattgggaaggtatggtgctgttgtccagttcgcccagaacgaaccatgtgctgacatcgacccctgccagcgacgccgattggccgggagtcgatccggccgcgagcggtcttccggtaacggtcgaaacggcgtccgctacggccccggacggctccgctacggtgtgcaagcttactaagccggccgggagtaccgcttacgtctccgcgccgatagatgggccgctggggtccggtagcactgtaacgttctcgttcttcgcgaaagccggctccacccgtttcattgcaattcagtcggctgccgatttccccagtcgagccgatgccgttttcgacctggattccgggcacgtgatcagcgatcagatgttggacagcagcgtggtaagcgcccgaatgattcgtctggagaatggctggtggcgttgcgttctcacgaccaagaccgtcagctcttcgttccgcgcggcttacatcgctccggcagaaaccaacttcagctggattgattcgaattccagcgcggcgattgatgtgcttatctggggcgctcagatcgaactgggtgatactccaaccggatacttggagactaccggaacgcccgtaaccatcaccgattacgttttgcagagcgcccagaccggaacggtcaagttcacacagcctcttccgaccggagtagaggcgtattggactggagactggaaaggtgggtctgcgaccgagccggccagattcgcagtaggggatgggactcaagatacattcaatctgtccagccctgcatacatcggcctacccactagtggggcgttcaagctagaatacagagttggtccggcgcttaatttgtcgccgcaattgatcaacctcatgaatgaccgggcggtcggtatcatgccgacttgcgccggttgcgatgtaaaagtcattcaggagtaatgacgtgatcacacccgaactgatacccagtccgtttgctgcgcagggcgacaaagacccgatcccgcagacctcttccactggctttgccaaccttcgcgacggctacacgccggactacgaaatcagtctggcgtcgaacaacccgcaggccaaagcggtcgagcggaaaattcaaaaccaactcttcttcatcgcgacccagaacgcacaggcgtggcagcggcaaatggcgccgccgtggtttcagggcatgcctggcggctacgaacagaatgcagaagtcgtgcgagtcggcaatgacggcataatgcggcgttatcgttccatggtgaatgccaacgcgagcgaccctctcagcagcacgacttgggaagaacaacccgcatggtcggtgatgcgctccaacataccgatgccagctggaggcccaggcctatcttctggcggagaagtcatcacgaccggccgcaacttcaatgacctgttgaatgggacgtgggagttcttctctgattcagtggtcgtcgcttctcagaacgcccccgtatatcccgcttcggctggtgcagcagctggaatgttggaggcgaaatcctggatatccgggtccaatacattctgcgttcaacgctacactgaccgcgtcgggaacgtcgctgtgcgcgggcttaatgccggggcctggaccaactggatgtacgcagtaaatgtcatggccctccaacaaggccgtgtgacctatggggtcgcggctggctcggcgaacgcttacacgttgacgctcgttccgcagctccaaggcggcctggtggacggcatgatccttcgggtcaagttcaacaccgttaacaccggcgcctccaccatcaacgtctccggatttggcgccaaggccatcgtcggcgcggcaaacttcccgttgactggtggagaactcggtcaaggactcattgctgagcttgtattcgacgccaccggcgaccgttggaggattctcgcaggcgcgccgcgcatccaagtaggcaacgccgatcaagattatcaggctcccagctggaaacaggttaaggactatgtagcgtcccaaaagttgactgaagtggactgggctgacgtcgtcaacaagccgaacgtcgccatccaagacaccacaccgtggttcgccaacctggagctgtctgacgctcggcctttcatagatttccacttcaacaacaaccgcgccaaagacttcgactatcgctttatctctgaagctgatgggtcgatggcgttctattctcgccaggggtccgctggtcctacccaggatatcctgttcagcaggtcgaatgttacattcctccagccgcgactggatgttgcgaaaaacctcgcgtacatcgcgaactctggcccactttggcagaacaccactgccgatcagcctggttggaaattcaccttcgcccaaggtgtggacgccaacaacaacgctgtgatcgcagtcaataccacaaatccggacggctcttatcgctcgcaaatcatgcgatgggattgggcgtcaacgaacgtcatattcaacaatcgccctctgtttgctggacaatatgttccgtgggactccggaaactttgatccggctaccaagctcactgtcgggactactaacaacatttcggggccgaccggaattcgcaacaccaccagcaacaccggaaatatgaacacctggggttccagctccacgactgcatcatatggcaacgcggcacttcaaatcttcggtagagggggtggcgagcctgcggccatatacttcgacaactcccaaaccggctggtatttgggaatggacaaggacggccaactgaagcgagcaggctggtcgctcggcaataactcctatgtggtcaccgacgaatccaacattcgtttccacgttaattccatggctggtactcctgtatggggcggaaacgaattctgggggccgtggaacttcaacccgaacaccaagttgaccatcaaagccggcacgcaggaaactagcagcactgcgatattcagcggaacgctgccgttcgccccaatcgcgtctctgtccgactattcccaggcgccattgacggtttacaactcgccgactggtccatccgctaagcctgccgttatcgcgttcattcgccctggaaactggggagcgttcttcggcatcgataccgacaacaagctgaaatggggcggcggatcgctcggcaacagctccagggaaatcgccgattccagcaacatcatgaatctttgggcggccaacccgaccgcgccgtcctggaacggccaaaccgtctggcgatccggaaactttgatccggcaacgaaagtggatttgaacgccgcgaacgccaccaacggaaacatgatcttcaaccgcatcgccggaactggcagcgggatcgcctcttccggccgcgtcggcgcaatcagtctccagaacggcgcaacggcaggcgccgccgcagccgtaacattcgagcgcggtggcggtttcttcgtcaacttcggtttggacacagacaacgttctcaaagtgggcggcggaaacctgggggcgaacgcctatccagtcatccacgccgggaactacaataactacattaaccaggcgctggttcaggtcggtctgggcggagtcggttcctatggcgttttcgcggttttggataatgccgctccaaccgcaaccgttcaacccggagttgtcgtggacggttccattctcatctactcatcttgctccgcaaactacaatagcggccaaagacctgccggaacttggcgctgcatgggctatgtagtaaaccgggacgccaacacccctgactccgcgacccttttccagcgagtgacgtaaaatgaaatggacgcggattagaaacccacgttggctggacgcagtaaacatccacgccatggtgactttcgagggaatcggtgaagtgccgttcaccgccaatccgcaagacgttgaggcccacggaagggccatctacgctgcgattctatctggggagcacggacctatcgccccggtcgattcgaagcgggagaaggccttgcaggacgctatacgagccagggaaaagcgggctatccttcgggatacccgctggcccatagatcgccacgacgagcagagacggctgggtatcgaaaccacggacggccctgggctgatcgcagcccttgttcactggaggcagcagattcgcgactggaatagcggggatcggccgcgacttcccatggctctgaaaacaatgttcaaaaatcaggagtactgatgaaaataacgaaggatattttgatcaccggaaccgggtgcaccacggatcgggcgatcaagtggctggatgacatccaggcggccatggataaattccacattgagtcgccgcgagccattgcggcctacctcgccaacatcggagtcgaatccggtggactggtgagtctggtggagaatctcaactacagcgcccaaggactggcaaacacttggccgcgccggtacgcagtggaccctcgcgtccgtccgtatgtaccgaacgctctggcgaaccgcctagctcgcaatccggtcgccatcgccaacaacgtgtacgctgaccgcatgggtaatggctgcgagcaggacggggacggctggaagtatcgcggtcgcggcctgatccagctgaccggaaaatcgaactatgccctgttcgccgaagactccggcatggatgttctggagaagccggaactgctggaaactccggccggcgcgtcgatgtcttcggcatggttcttctggcgcaatcgctgcatccccatggcggaatccaacaacttctccatggtcgtgaagaccatcaacggcgccgcgccgaacgatgcgaaccacggtcagctccggataaaccgttatgtgaagaccatcgccgcgatcaatcaaggctcctgatcttctccgaaaagaaaaggccgcttattcagcggcctttttgctttccggctttgcctcttcaatcttcctgacttcaatgggcgcggcagactcttcctgggtgaccgagtccacatagttccctagcgaactcagaacgccgattaacagcgctctcaccaccttatccttgactgtctcgcctatgatctttgtcagaacggatatcaactcttcccggagtcttgggcttattcttggccgaaagcgcttgcgatgctctttgcgtttcatgtttagtcctctgtttgcggtcttctcctcaccccgataatggcttggggatgcgctgtgttaatcggaagggtcgggcgttattataactcgacgaaaatgctcgcgcttaactgtttaacgatacgcaccgcgatattaaatcgccttctttctggccaaggaactctggcggccgagtccggtctaaggcttaatttgtcgacattaaaacgagaaaacccggatcgcctttaggataaggcgatccgggtttatttcgatctagtgtccgctagaatcagtggctcgcgccccatccgtccaaccagcagtcgaagacggcatggcgcggcttatccttcgcaccatgcgggaaatgcgtgaatcggatgacctgaccattgagggattctctgtccttccagagacgctgcttttcatcgtgagtgatgctggatgccgaaaccctgaatgtctgcccaggccaaaccttttcgttgcggcagacgaacgaaccgaccattccggacggaacaaggttttctgcgtggctggaacgggcagtgtagccaagctcatcgatgaaggcttcgttttcgttgatcatcaactcttcgacgccgataatttcggcctcttcggaatcgtaccgcttgaacttcacacaatggccttctttcgcggtcgagcgaccgaacttgtaaattccattcttcttcttgccaatggaaccttcgaagcccaggccgacgtgccgcagctccgcctctgtcatctgttcaacggacgtaaccaactcctgctcgaccaggtggatgcgggtcatttcgaagcgttcccggagttccttgacccggtgctcggtcgcgtcgaggcgttcgtcagtcggcattcttggatcggtgaaatcgtcgaacacgtggaacgaccagtccggttctccatcgcggcggcgaagatcgccggacgatttctgaaagactttcgggtcggtgatgtcgccgcagaccaactcgccgtccaggccgttgaaaataggattgctgaggtattgattgatggccgcgttcgcctgcggcttgaaggatcgggtcagagcgtggccatcgtggatgaaggcgcgaaagccatcgatcttcggcgacatgaagattggcagttggccttccagcagaccgggatcggccatcgatgcgaacatcggtttcatagaattctccagaaagaagcccggcaaaccgggctgaatggcggtaagccggatcagatggtttcgttggcgtgattcagctcggccatgatcgatgcatagcgctcatccgactccttgatgaacacgccgttgtacatcacgcctttgcgatccttgatggtgtcgtaggccgcctggtagcattcgagcatgctggtgtcatgctcttctgccgcgtcgaacagggatgcgactgccatgaccaaactcttgatggcaagccaacgatttccgcgagccagcgagccggccaggtcgccgagtaatttcagatcttcgccgtaggacgggcggcgctcgaccgccaagacgaaggccgacatatggtcgaacagattttcgccgagctgcgcggccatgatggtggccacgaccatgacatcgccgatgccgtctttcacttcggcggtgttattctggatgtaggcttcgcaaacttctgcgaattcttctaccagcttgagaaactgatctttggccgaagagcctttgatcaggttacggtctgaaccccattttaccaccaggtcatggagttcgctattcatgattcgttcgatgatcattctttcgattccttctgtatttgggatttgactgcgttgatgatggacgccgtgctctggcgcgatccgtccttagtggtgccgaagtaaaaggccataacagacttcagttcagcaaaccaatagccgatgatggtgccgatggcgacggaagaagtcgggtccatcagcgcctcgcgaccgaatgtgaaaatcgcgatgatgatgagaatggaaccggtcagaagagcaaaagttatcgccgggcgaacgaagtcattttgttgcgcagcaagccttctcgccgaatccctgtctgccgcctcagcggcgaactggctgagttcggcttggagctggttttgctcagactgaagacggttttgttcagcctggatggccagctcctggaggcgaacgcgctcggcgctctggagttctgcgagacgcgctagagcctcgggattcgcgtctagagcgctcgcgaccgaggctgggtcggccttcgaccctagcgccgtcgcgacgatagcgccaacggcggcgcctgcaggcccacccaggagcgaccccagggccggggcagccgcgccgatcttactacctatgtccttccagtccatttttcaattcctcaaaagaaaggcgccattacagcgcctttctctggccgttgacgttagaactcttcggcttcagtggcgtcgcccacgccaccggcgtcgccgcgaggctgttcctgcttgctgtagtccaccttcacctcaccgccgacgaacgacttgtacagatcggcggccgccttgaagtgatccgggtttttcaccaggccttccagttcgaactggacgccggaccagctgcccttgtcgttcgacatgccgacagtggtcatacggaccaggttggcgaaagtcggcggcgtgcgcaggccctgcggagtctgaactttcttctgggacagagcggtcatgagcttcttcgaggccttgatctgcgaagacgacagggagatcagggcctggccgaaatcgccggtttccggatcgatgacgatgacgtaatggccacgggtgtcggcgaagtaatcggatttcttgtcgctgaccgaaccgtcttcattcggcgcgtacagacgcccttcgacttccttgaccttggtagggtctttcatcatttccttgaagtcttcgacgctgatggaccctttgaaaccgccctcggcgtcgcggccagcccagcgaatgaactcgcgacgatacgcggccgggatgatcagtagaccggttttgccgtcgtaaatcttgccggtgacggtgttcaggaacatgccgggcttcgcaccctcgatgtacttcgggtcgtcttcatcgacctgcggcgacatcttttgcagcacttggatgaagggaatggcataggaatctgcgtcagccccttcgaaaccggcgccgtcatacgcgcccaggtccatgaagtcgggaacgtcagtagtcgctacggcgccgccgttggccactgcaacggccttggtttcttcagttgcttcggaagtctcggttttcttgccagccatgttaggctccttgtttgtcgaatttcagttatttctaactgtgggtttataataacgtaagttgcaactaagtaaagcaaattacatattaagatttgctctttttcaccttcggcttcgtgatcttggcctctttatattcgtggacgccgatgaaatctggcagctcttcgcccttctccaggtactcgcgaccgaacgcctggagggtctggtagtgaacatcgcggttgatggtggcgtcatagccggcttcgatgattgcttcggccgccttcttcgcatcttccatttcgccgcgaccgaattccgccagaactttggtcttgatgatgccgtcgttgtcggtgtcttccagccacttccagaacttcgacttgttttcttccttgacggaaatgatggctttcggctcgacttttaccgtgcggccatcagccagagtcgtggtcttctggccgagttcctccagaagctcaggaatggtgttgcgcttgagggtcttcagctcttcctctttttcggccagcgccttttgtaagtcgaggatttcgccgtccagctgagacgccttgtccaccaagttcagcagtcgatggccaatgtcggtagcttcgactgccatttcatccatgacgccgaaatagtcaatttcgcccggcgcattgtccttcagatactccggaacttccaattcttgctcgctcatgtcagcctccaacttagtgatgttcccttacttgaactaagtattgagtagatattatgccgcatcttccttgatacggctactgatttacatattaaatttcgtcgcgagtgctaacgtcagcctcgaacactccatctacgacataactcgcaagattgcgcttccactccaaactggtctggattttctcgtcgatggagtccagacagatgaggtcgaagtacagaacagagttgacggttccgatgcgatggttcctgtcttcggactgcatccgcaactcgttgtcttcgtcggtcgtgtagtaaattgccacgtctgcggcggtgagcgtgataccgatcccagctgcggccgggttgcccaggaagacttggacgcgcttggcctgaaaatcatcgatcagctgttctcgttcggcctctttggtctcgccataataggttccaaacgaaattccttgggactcaagatacgcagcgatctgaccgatttcatgaatccgcatcgcccagatgatgatagaccgttccgggtcttcctccaacagaccctccagaagatcggtgaacactgcgaatcgcgggttatcttcgggcggcaggatcaccggttccccataaacgttgatatagccagatgccacttgcttgagcttcgaacgagccgcagcagcgtcgaacgatacatccaacatgaaatcttcgttcttgagcacgaagtggtagtcttcttccactcgccgataaaccttcctttgctcaggcgacatttcgaaatatatgcgcttgtaaaccttttctggcaggaatggcaatgcctctttcttcgtgactcggaagctgtgcggctcgatcagggaccgcagtttgtcaagatttcggaatactggtcgcccaaaatcgtctttttcgacgagctgaggtggaacagtactcttcccatccaatttgcgcatgatggcgaccattcgcgggtcgtcacttggaaccagaacggaaaattcggccacgaacgcccgataggatttcgtccccagaatgccatcgcgcagaaattgaaactgcatgaataagtccgtaggcgctcgcgtcagaggcgtgccagaaagtatgcgacgcgccacggcctcttcgcccagcttcacaatttttttcgcgcgtttcgcctgtgggtttttgatcctcgttgattcgtccacaatcgcgcatactcggaacgtcttgaggaaccgcttgacttcgtcatagccagcctgatggttgatggcatcgacgttgatggcaaatacccgaagcactttttcgtcggagaacgtctcggcatacaaacgatcaagacgcgccctggcctttttggaagttggtctgccgcgccaatccacgcacagagtcttgactgcgacgtgagtaggaatttcgcgcaaaatccagttagtatgtacgcctttgggggcgacgatgagcagcgcgtcaaccctttcttgcaggaagagtctaactgagtctgccaaagtagtccaggtcttcccggtgccctgctccatcaggtatgcgaaattccttttgttgagggaagcttccagggcattgaactggtgttgcatcgcctcggtcttcatacccttgactggaaaggttttggctttcatttgttctccagatcggcgagaaattgaatgatgttgtccagtccttctgcatgactcgcgacttccacaaggtcgcggctgttaagatcgaacagatcgagcatgggattcaggagcaaccaatcggttccgatcttcaccagaacgaagccgcgaccaccccagccgatccgctcccgaaggaaagggatttgcccaggctcgaaacagcgtgccattgggcaggtcgaggcgcgctttggccaagcttccagagccttgaactcgacccaaaactggacgccgtgacgattcagacagatcgaatcggacatgccggaccggcgcgtctccaggaaatcgaccaggattctgcctagcgagcgttgcttaaacgcattcgcggctttcgtttcgcgatcattcatcgccattcccctcttcggaatctttctctgcttgcgctgccaactttgctttctcgcgttctgtcaatatccgcttgacggccttcacgatgaacatatcgattccgctgagcttccatcctttgatgaggaaccaagagccggtcggcgtcccttcggcaatattctttccgtaccgaagatatttttcaggacgaattctgaaacgaatcggttggtcaaccgagtcgtccacgcacattaaatcgaggaactgcgactggcctttatacaccggattctttccttggtcagccctcttcttctggcggatcggttcattctcatccgacagaactttcttcaccagctttacgataactaggccatcgtcgccatcgcggatatcccgaatgttttgaatgggatttccggaagttaccccaaccaactcaggattgtcataggcatgaccccagagtgtatgagattcgttcaaatccgcgaattgaacctcggaatttgacaaactcgcggcgactttctcccaatcctgaagtgttttaagatgggagccggccagctctttgtattgagccttcaactccttcagttcagctttcaactccttgagatcagctttgagtagcttctccagttctttgtctcggctgactttcgccgaaagaatctgggcttccagcgtggccacgtcatcagccttatcctctacatcctgcgccgaaatcgggcaattggccagggcaatcctcgcggccttgacttcctcgcgaagacgcaagaatcgctcggccttagccgggccgaagcctttggcgttcatgatgccgccgatcaggcgtccgtccgctaccacccagttgagttcggaatgctccgggtccagggccgtatattctacgccttctttggccaattcgcgaaggatagacacagtctgctggtcgtccttcgccgcccgaaggcacgcggccgcgtattccaggcgatgataccgcttcatgtagcaagtccagtatgtcaccacggcatagcttaccgagtgggagcggttgaatccccaggcgccgaacgtcaccatttcctgccaaactcggtgggcgtcttccggggcgactcctatggtcttggcgccttcgatgaacagttctcggcgcttgttgaagaactcttcgccctttcgcgccgacatcgctttccggattgccgacgtttgttcccagtcgaactgaccaatgtccttcacaattgacatgatctgttcttggtacaggaacacgccatacgtacccgacagatactgttcgacctgcggaatggtataggtcacaggctcgcgaccggccacgcgctcgatgtatttagtggccatgcccgaagacaacggacccggacgagcgagcgccgtgatgtggtcgatgttttcgaacgcggtaatgttgatcgcattggcgaccgagcggacggcctggccttcgaactggaagatgcctgacatcttgtcttcgttcagaacatccaaaaccgccttgtcgttcagcggcaggtcgtacaactcttgcgccgtcacacaattcgcatcttggattacgcccagcgttcgaagacctagcgcgtcaatcttgagaagattcaaatattccgaatcaggcttgtcgagctgcgcgacgccttcagaagtaaccgtacagaaatcgattacttcatcgttgcagaccaggatgcctgccgcgtggacgccggagtgggatgggtgaatttcgaggtcgcccatgcaggcggacgcaatctcatacttttcgcggaagtcgcggccgggttgagtcttttcgaaagtgtcctccaatccttttccatatcgttcgtccgccgaagtatattcgatgatcgagtttttgatgttgtcggtgtcatggaatggaatgccgaagcgcttcccgacgtgagcgataaccgacgcggcctttagtgtgttgatgttcccaagctttaccacgttccaagtgccgtatttctgctggagatattcgaacactagatagcgatgggtatcggcgaagtcgatatctatatcgggaagatcggaacgggaaatgtcgataaagcgctggaagagaaggcgatgcgggagcgggtcaacctcggtaatacccagcaggtagcagaccaaagagccggccgaagagccgcgagccggaccgaccagcatatgcttcttggcgaaggcaaccagatcggccaccaccagaaagtagctgtcgaagtctttcagctgaatctgcttgatttcttcctggaaccgatcttcgtaaacttgggtccattccttgatgtggccgcgactgagacggtaggcttggccctcgcgagccagggcgacgatatcaccatccaggtggatcatcggcgctttcgccagctttacatcgaccagctgctcgaccaccgcatgcgtgttggcaacggctttgtcgaactcttcgcgggtcatgatatggcgaagacgggcccacaactcttcctcagtcgcgatgtggcgaaggccgaccgattcccgaaccttccaggccgaagcaaaatctgcatggtcgatggacggcatgtcgttgtaggaggtaatcaccacaggcttgccgaacgccctggccgtctccatggcgccgtgcgcggcgaccatcgacgcaggattgatgtcaatgtagtcgattccggccaagtccaagtgggcataagcctcgccggcaaacttgatggtgccgtcagcatcctggaattctttgggcgacaatccttgattctggacagtcttcgaagtaaggcgatagaattttctggtgtccttggctagcgcccaggccttcagcttcagctctttttcgccatcatcggcgcatttgatcgggatttccatgccgaatccgcgaggcaattctgctttggtagctgcctgctcccagcggacgtggccccaggtcccatcatcgacgatggcgacaaagggcgattcgatttctttggcgcgctcgatgatttccggaaacctgccatatgcggcgccgtatgagtagccggagcgaacgcggagttgagggaaagacattatgcggcctccattgcttgatatgctcgatatactcccatgcgcttgcatacttcgtggagcagccgcacgtcgtccaatgcccggtgcttctgaacataagggccgcagtagtgctcatacagatgctgcagccgcatgcggtggccgaacaatggcgccgactcttctacagtacatatatcgagcgatgggaagttgacttcttccaggccgagctttccgcgagccaaatcgcaggtaagcatgaatttatcgaatggaaggttgtgggcaatatttgcgtcggccttcgaaaagaaatcgcgaactttctggcgttgatcgaggaatgatgggtgtttgattaagtcttcattcttcaggcctgtgatctttgtaatgatttcttcgatcacaatcccagggttgcagataaactcgacttcatccaaaatcgtctcgccatcggtgatcactccggcgaattcaatgatcctcggttgctttctcagacttaccctctggtggaacgggagtcctgtggtctcagtatcccatacggcgaatctcatgtctgttccctcttatgtcgaaaggccggctgctttcgcgaccggcctgaagagtatactgcaacggcgcagggtttatgccttctgtccgtctttcggcgtgatgcggccggagtgcatggtggcgtggacaaacgctgaatagttgatcaagtcaaataccgaatcgtcatcctcaaacccactattcgccaggcgagtgagtttaccaactgtatgcatcacgaacagggcgagccgatggtcatctgcggtcttcgccaccatgccattcgggaagaggatttccatgatcttgccatacataagatcatttcgaccataagcgctctggcggtcgcggaaaatttctgctgctgaggataggttgttgagaacatcctccacgaaatcatcgggatcggcatcaccgtcaccaggccaggcggattccatggcgaactgcgctgctgcgtcttcggtcggctcttcggctggctcttcggccggtgcttcgtagagcggagacggggcctgcgcaagcgcctcgtcgagggtaggggcggagtaggaggctgcggcgatcgtctcgcctgccatgtcgttgggagcgctaccggggtcgctatcggggtcgctatcggtcgcgacggcgaagaacggcgcgttacaaccttccaggtccagaatgtaggcgtcgatgcccaggcccttgtaggcgtcgatgatatcctggcgatcatcgaatgccgcgacgatcttggtcaggccgtcgatcttcttcagaatatctagcgcgactgagcgcttgaactccggcgccggctgggtgtttccatactcccgcatgatgagctcatattcgcgatgttcggcgatacccaggtcgcgatggattttcgccctggtctggaaatagttgttgtcggttcggccggtgatgaagaagatcatcaggtcggcgtcgatggcgttacggattcgtgcgactgcatgcggattgagcttgtccttgtcgaggcgggaatggtactcgtcccattgcttttccagggcgaagcttttacggtggctatcgtcgaagacgcatccgtccagatcgaagatcatgatgccattcttgggttttcgtgccatattcagatttcctcgctttctgctttctgggtgatggttttctcgatgaaagcgccatcggaagttagacggaacagttcaccgttctggaccagatcgaacgatttcacgttcatggtgacgcgaattgattcgccgccgttggtcacttcgacttgtgcgacgtcaccaaccttctcgatgatgatcttcatgctacattgacttcccattgaccgctacaggattggcctcttgtttctccgatccccagaactcgcggcgcagctcttcctgctcggccgagcgatccatccatggacgatagaacttgcactgatagatcggtttcaccggcaactcaaccacaggaatctggccgggcttcgtccccagagcggacatgaaggtgttatatgaaccctcctggatttcctcttcattcagaaccttcgatccatagcgcgggaaggcacaggagccagtagcgacgcagtgcggctggagcagactatcgaacatcggatagacttccagaaccagtcggcgcatttcgcggaagacttcctgatactccccttgcgtacgaacacacaggcgaactttcgccatgtcgctcagagtgcgcagattgaacttggctgcgatcttcgtttccatgttggaagggatgatggcacgagcatcctggagcgatgcgccggcctccaagagcttctggtaactggtctgcgcgtcggcgatggcatcgtgccacaggcggttcaactcttcgcgggcgtgataggtcgggtccggctcgccattggccgtagcctgctcatcgaaatcccagcggaatgcttccggctgaacaacggcgctaacctccagggcgcgactggtttcctgctggtaagcaccggtccgcgtccggacgagttggtgggtgaaattcttgcttacgccctcgatctggaaaatgaagtccacgaattcgaatggcgagcgaatggtgtccagcatgtacttccagtggtcgagcttttcggcttcggtcatggtcgccgggtcttggccgcgcatgcgagtggatttcgtccccaggagaagttcccaggcgttctgggtgtaactgatcagagaaattttcatcagaaatcttccggaattggcgtgaaagtgaatttctccaccagcgccatagccaacgcttgtgcatcttccttatgcagaccgtatctgtcgatttcttcggccagcaatctgcaagcctccagacggtcttcatactcttctgcttcgcacatcgacgaaaagatagtgccgtcagaggtccggtacaccagctcaatggacatcacttcaatcctcagtagcagcggatgatttcggcgcgaatatcgcgacggtccaggtaatgctcaataatcttgtcgcgggcgcgctcggcctcttcgcggctaccgaacgacaggttgaatgaagtgaaaggcttatcatccaggcgtccatcgccgatcaggtacaggatgcctaccagcacgaaagacggcgaggtcttctgctgcgggtcgatttgcatttcgaggaaagacataggaacctcttcaggttggtctggtgcgtacattaatagcgctcctgctgagcggccactgtttccggttcgtagatgagcatgtccacgatttccgggcactggcttttcacccagtcgattgccgcaaccatcgttgtgtcggcgccgaaggtgaaagttcgataagactcatggatgtacggcgaacccatgaagtcgcgctcggtcgtgcgagaaatgacaactttgatgttaacaatccggcccatcttcggcctccactttagcgatgatatcggacaggctcagcttctcgccattcaggaaataactggcgcgaaacttcctgtcgccttctggcccgacgatccgggctgttattgtgagactcccgccgccaagggcatccgtgtccctgaagaaagccagcagcgcccgcttgagcgctgcctcgcgaggatcgactgccattaacctaccacattccagccgtgctgggcgcaccaaaccgcgccagttcccgcaggaagactgttaagaaggaatacaggggtcaggcggccatcctcggtcatgtggatgaagtagcgtgcactttcaccgagccattcggccttggcgatggcgcgttcaagattggccttggtggcgtaggtcttggtgatgtttttgtcggtggagaaggttacttcgcgggccattttgtcgattccttttggttgaagggtttcgcgtttcgatgagggaatactactctcacctggctcagaagtaaagcactttgtgtaaattatttcacgaacatcttcttggccttctgataagacgaagaagtcatcaggcgctcaatgacgtccatgtccgaaaccaaatcgtccagaaggacgtttcgccaggtcgcgaaccgaccgagcgagaagatgccggcttcatgggtgagattccagatcatggattcgcgctcgtcgcgaccgagcggaatgattttgcccttggtctggacggtcggctcgccgtccggaatgagattcttcttcctgatgccgaaggccgaacaaacttcatccaggtcccagttgctgtcccattcgatggtttcgatttcaccagccgcagtctccacgatgcccttagtaacggattcgacgataagggtgtcgccggtgatggacgctcgaaacgttcccacttcgggaccagggaaatacaccgtctggaagacatcacaaggaatggaaagcttgtaccgactcacgacgatggaggttccttcgccgaatgacgggtcgatccccaggtccagtcctgccgcagccagattggcgcggaatggtgctgtgctgatgatattaacgtgatcatcttgccggcgaaggaactggaagaaagaggcgtcgaaaggcctgccccagctgatgcgattcgctagcttagcgaccagctgctcatagtagtcggccggcgcgatccagcgcttttcggtcgccatgttccagatggaccgatccgacaggccgcccgttactttcctggagtacatgttgcagtagtcgatgcgcggctgggaaacgaactcgccgtcaatgtagatggccttgtgtacggtgacttcgcggaatgggatgccggtgagttggccgatgactggtgagcggaaccgcaagagcgcgttgtggcgttccttgctcgtcggcgtcgccgcgtcgatgatttgggcttgaggaaaacgatgcgcggcgatcaggccggcgagtccggctcccacgatgataactttatgatcagggatcatgatatgttccttatgagtgtacagaacttgagaggataaaaaagggacccattttcatgagtcccttgaagagctagacgattcggtctcagaagagcggcggcttactcttcttcaccatcggaaccgtcggcgccctgaccttcaccgtcgtgctcctggccttcatcggccttctcgtcatcgccctggccagcttcgtcttccttcgaaacgatggcaaccagatcgacccagcccatgatttccagcttgctcagatagctgcgaaccgaggttccgtacagcaggtgagccaccttctcgccgaaggattcgatttcgaccggctcaccaacggtgcagtgctcgttgatgtaagcgaacaccttgccgcgagtcgagaaggcctgcggggttccatggccgtcgccggtcgggatgaagtgggtggcgcgcggacggcgcgaaccattggacttcaggtcttcgcggcgggcttcggccttcgcgcggcgctcttcctgctcttccttgcgacgcttcttctcggcctcgcgctctgccttcttctcttcggccaggcgcttgcgctcttcttcgcgtgcggctttctgggcttcctgcgcggctttcttctcttcggccttcctggcgcgctcggcttccttctcggccttcttctgctcgcgctcggcttccttcgccttcgccttctcggcctgctcggcttccttggccttggccttttcagcacgctcggcttccttggcggcggccttttccttcgccttctcggcgcgctcggcttccttcttctcgcgctcggccttgcgcttctcttcgcgctcggctttcttctgctcggcttccttggccttggcttcggccttctcggcgcgctcgcgctctttacgttgacgctcagcggccttctcggccttgcgcagggcggctgcttgttccttggtcagctcttcgccttgggtctgttcgttctggtctttctgttccatgttcttactccgggaatgttttaaagggatggcttattggcctgtgaggggattatctctaaactaactgaagaagggaatacccttagcctgaactttcctaaatattttctttcgggaaagtccaaactctagggaacttatttatgttcgagaaggtactagcttttacgcaagaacagcaagtattcaattgcgcgagttatcccagtatacatcaattgactataagggatggacggtaagttttcttccaacattgcgacccgtttccattctgacccctgcgacttgtggaacgtcatcgcccagccgaagtcgaatccgccaatggccttctgcgcctccagccgcacgtcttcctcggccgaaaagctcagagggttgaacttcacccagcgctcatagttcgtgccgataatgcgaactttggcgaacaacatctcatcaggctcgtcgtcatcttcttgcccttcaggaactggcttgaagtccagcagaatggcttgttcgccgttcatgattccatattcgtgctggttcccagtgcataccagcttctcaccgattcctggctgcacgcctttgtagccgaggattcgccgagcgcgcgcgttcaagcgacgacgagtattgttgtaagcacaaagaatcacgccatcgtcgtccaggaacgtccgcatttcatcatccgacatatcgaagccggcccggaccaatatgtcgtcatactcgcggcagggcaggcgctttccctggcggacgaacatcgacgcccgaacgatattgccggcgttgcgctcgatttcggtcatgatggtatcacaactgttctcgtggaaaatctggacgccgcgtacaggaggaacttggccaaagtcgccaatctccagaaccggaattcggtgcgacaacaggcgctcttcatcccactcgccgatcatggacgactcgtcgagcactaccaacttcggcttctcgtcgagcgagtctttgttggcaaacatgatttcgccgtcttcatcttcaccaatcggtcgatagataaagctgtgaagagtcctggcattgacgcaacctttctcacgaagccgagcggcagcctttccggtcggcgcgatgaagactgtccagtccatcgagcagcaaagttcggcgatgatcttcgcaatagaagtcttcccagttccggcaaaaccggcgagtcgatagacctgacggcggtgcgctcgatcacaccaaccgcgataccagttaacgacggaattaatcgcgtcgatctgctggctattaggtcggaagccgaatcgctcttcgatctgatcgacggtgaagttagatgctgacatatttgcgttctccaacgctaggtttaattgaattgagactcagtttaagcagaccgtccacagaccacccagtatcacgacgatatttgcggccgtgcggatcgacatagaagtttttcgtgcgccgcaacaggacatagtgccaagcagcgccgagtgcatgaacccttcctttataagggaaggccttaagttgctctgcggccttcttcgccccagggagccagcggacggtcgaaaggaccaagaccgcacccttgacagcctgggaagcggcgcggccgtcctgtgggctatagcgatgtctatcggggtctacccagtggtggttgccacgccggagcttcaccgtccgggaccggccctcaaacaccacagtaccttcgtgagtaaaaatgtgttccgccatggaatgttccttataacgtacagttctgctttacctctgcgcaagaagagtatactatcagctgactcgtcaaagcgagcgaatttaatccaactttacttcggcaggaaagtggccgatactagcgccgccgcctgtactgccctccaaaacagaggatacattaaatgcaagaatgcaagatttcccgcgaccaactcccggtcggcaatccgaatcccaatgtcgacaagactcgcgacccgaacctaaagcccggctacctgcgtcgcagtcgcgagctggacccggctctggccgttcgcatccgtcgcgagctgatccatgcggaagcctccgacttggccatggccgggtgggtcaattcccagtccagcctctatggatcgaaagcgttcccgcgccattccgtcgttcgcgtgactgggatggcggaatctgaaacgaacatcggaatgctcatcggcttcatcgagcaccgcaagcacggtgaatgggcagttctggaaactgggacgaaagaaggcggcgcgatcaccatcccagtcgagagcatcatgcgtgcgtcattcgcagaggccgaagaattcgccgagaaatggaagcgtaacctggggtggcgcctcctgcgtcagcttcgtgaatgcggcgccctggccgggactgaagacgaattcctgcggcggatcatcaatcgatatgttcgcgatctcacgatactctcccaccacaaagccggtgcagacaaaagctataccgatgcagtgctcaaaagtatcggcgaagcatggccgcagattcctgccggaacattcgtcggccaccgagtcgcgcaactcctgatcaatcacaaactaggccgagctggcaccatcttgaatgacctggtggacctcctggagaggttcgcggccggtcgtgataaagtgctcaatatcgccatttgtaattgaggttagtgatatgccagatttgatgaagctgagtcataggcaagttgaagctctgctagggctgtctaggaattcttacaattggattcacggtccttcgactgattcaaccttgaaggctctgagacgaatgggactcgtaaatttgtcctgggatgattctgtagctggatacatgttcggcagtcagccttgttggagcataactgacgccgggaaaaaacgaatcctggcaatgcagggaactctgacagaagagcctgaacagcaatttaatcccagcccatgccgccatgagccaggtaagtccgattctgatcgacttgctaagcaactagaaaacatcgctcgtctggaaaaggaacttgaagaatcggaaaagcgcgggagcgaactggcagcaagctattgcgacggcgtggtcggtgatgaatacggtcacacttactgccgctacagggtggagcgcgacgccgctctggccgaagtcgagcgcctgcgcgaggaaaacgccaatctaatcctcgcgtgcgcatcgctggatagtgagaagcgcgagatgcagcacaagtgggctgcaatcaccgccatgcgcggcgacgctctggccagggtcgcggagcttgagatgaaactggacaaggccgactacgcctatgacaacgaccgcatccacatgcgcggcctggcagcgcgtgccattgcgcgcgccaaggtcttcgatgacggcagcgatggggccgatgccgagagtgcccgcagcgtggtcgccatcctccgcgaattactagccgtcgggggcgcctcggctcagcacagcgcgccggatggttatgccatgatcccggttcgggagactgaggcgatgcacgatgccgtaatggcgctgctgtacaacggtgtagcccgcaccgatacacaaaagctgctggatgcgtacatcaacgccgcgactaacaaggagtccgtgtaatggaaccgaagaaaccttcaccagtagatggagtcatcatgaccagcctcgacgttctcaggaaggcaaagcctgaagctcaggacgagtatgctctgtccatgttcgcaacggcgatccgccagaagttgcagcgctcccgcgataaaggccgaggcggctggatcgactgcgacgaagatgttctgatcaacggattcgccgaacatgcgctgaaaggcaatgagaacaacctcctggacctggcgacgttcctgatgttcatgtgggtgcgcggcatcgatgatgcgaagattcccccggcgctcgaaaaggcgcgacagcacaagatcatggaagcctggagtcgaatccatgaagatggcctaaactccgccagaaaggcgagtgctgcgcgacaattcgtggaagtgcctcgacgcaaagggcgcccggagcggctcgcatgaagcctcacgaaataagattggcccaggccgaagaattcctgagagaactcggccgagggattccggaagacgaacgggtgatggtcggctacgctgaagaggccacagtccagaccgacgaaaacggccgcaaactcaacgcaggctggtggccagtaccctggaaggaaggcaagtacatcaattccagatccaacgcctacgcctgtatctcgtcgtccatcaagacgccaaacccaaagaccggccagatgcgatactggcgcggcgaggcctctttcggccatggcctggcgttaatggtcgatgacatcggctccggcaaagggtccaaaggcgacttcgaccgcgacgagttccgcgagcgcctggagccgaccgcgattgtggagacttcgccgaacaactaccagttctggtatttcttcaaagagccaatgtcccacatgcttcagtttaaggcattgctctattcgttcgtggaccaggtgctaaagaaaggcggtgacaacaccgtcaaagatgtcagccgttatggtcgcatgccattcggcttcaacaacaagcgcgggaaagacggcaacttcaagtatgccgacgaaaacggcaagcccgaattggtgcgcctgtaccacgcagactattccaagcgatactcgccagaggaaatcgcgcaggccttcggcgtccgcatcatcatgccacaaatgaagaaggtggagataaaccgcgacgactgggtttatgaccaagtatggctgaagtatgccgagcacatctgcacgaagtacaagatgggcgaggcagctggcggccaagtccaacagaatatgtcaggcaaatatcgcatccgctgcccgtggggagacgagcatacaaatggcgatccattcggcgcctactttcgcgggccgattcctggagctgagcacgaatatgtgttcggctgcggccacgatacttgccgcaaagagcatcgtcggacgtgggcggccttcacggatgaagtcgtgctaccctatatcgtcgaacaattggaaagaatcaaccgccgtcacatcggtgaggagtagacaatatgcaaaacgatcctggaatcctgatcacagccattggcttgctgttcctcggccttatcatcttcttcgaaggcctaaagggatggaaaatacaagtcgcaaacttcctcgcgtcgcttctgtgctttttcttcggcctttctgctttgacgttctggttcgtcgttgcgtttgacgtattttaatcgacgaacggtacagaaattttcggatggggacggaacttattagctatgccggtttaggtaggagataatagccgtccctttcgcctcaatatgtagaggcaatgttgaatccgatcatgtaaagcagaaggcggcaaacctaacatgattatcgacgaagataatatttttgatgatggcgaatcagggtccagtgagtttgatctcacgcagatagaagatgctggaatggaccctttgatgaccgccgcgagcaaggcggccgatgatgcgattgcgaggaacgaaacgcatcgcgcgcaaaaggcggcaagatacgccgaggcgtatgcggaaccagacttgagaaagcgagcgcgattgttgatgctcgaccaggcattcgatcttccggtcagccgggttgtgaaagggccgttcgatgacttcatcacgaaatacagctcgacttccgacagcaactatctcgcggtgtacgatactctgttctgcaagggcgatggaaccgtcccgcatccgcacttcgatgagtttcgcggccggctggtggaccatcgcggcgtagcgttcaacaacaagaccctcgacccgattgacctgatgggcgccctcgcggctgcggccttggacgatccatcgatcaagaaaacgattgagacttgctgcgtttgggcgcgtagataccgccgcaactcgctgatagagacgttcgagaagaagataccggagtgggacggcgaagagcgaattagcacgttgctgatcgatctttttaagccattcgacaccgaattgaaccggatggtgagcaagtatttctggctgagcctgtactgccgcatcaactatcctggaatctcggcgccgatctcgctggcgttgattggtgggcaggatgcggggaaatcctatttcggcctgctgatctgcaaggaactgtcgggcggtcgcgatctggctcccgtccagctcgacctgagccgacacgaccagacaccattcctgcgcaacatcaccggcaactcggtcattgcgaacgtcggggaaatgtccggcttcaaaaagggcgatatggaacgcatcaaggagttcttggtgcggtcttctgatacattcgaccagaagtttgaaccgggcgagacgatcaagcgacaatggatcaccatcatggacggcaacggctacgatggactccagcgggacgactctgggaaccgacgtttctacccgatgttcgttgctcaactgcccgatgaggatggaaagccaaactgggtcaagccgggtgatggtaatgaaccgttcaaggtggacttcaccgacttcggccgcaaattctggcaagcgatggccgagtgccgcgcctggatcgaagagcatggcgtcgacggctacctgaatatggtgtcggaagcaaaccgcgaagtccagaacttctctatttcggaaatggagaatgcgcgtggcgtggttcgcgacgatacgattgatatgtatctgatcaatgttctgatcagttgcgagtttgaagaggttaagcctggcaagaattccaagactcctggatggcgggtcaatacagtggaaatcttgaagtggttcgatattctcgccaggaagaagccgatttctcgccatttaactccacacctgaaatcgcttggattcattccgaataagaacggcctgaatggatggctgctgcctgccgataaagttgccggacgggaaatggttgggtccttgccgtcatttaacgatgcgctgatatatatggtcaggaagaatgatgctgcggtctctgatgatgatgcaatgtcgcaaatccgcagggtcaaggcagatcgagccaagatattgggcgaggatttctagtgtactgatgcagctggagtgaattgtggttggactaggccgccttcgggcggtcttttctttggcgcggagaacatcaatttagctcgtgaacaggtgaggtttgaaagctatgtgggaattagggttgggtgaaggcgttgtattatgggaagttgatagattttcggtattggtctggcaggtctgatggttgaattttgtgtgaaatgttgagaaattatgggtttgaggtggattttttgtgggaaatagccgcaaattcctggatagctattctgactgggaagatgggaggcctactgccgcgtgggttagcggccaaattccctaattcccggtttttcgagcatggtttaaaactattctacagcgaaaatcgattgcacaatcctaatagaaaaaatctatcacggacgttacctatctttaaaaccaataaaattaatggtaatttggtaatttggaatagtttagtctttgaaagcctcgcggcactaagcctgtacattacccggcaagtttccgattccgctcaactcgcggcagggtcgccggaaacttccgtccttccaaaccatgggcagcggcaacaccacggcggactaagcggcaaggtccaaaaccggacgagcggaaccggaaatttggccacagggcagaatcgctcacctggacatattcctaacattcgatttaacattcaatccaaacactcacagccaccatcgcccgccaccagccaatccgatcctcacccaccagcataccgcccatataacatcctataacaccacctaacactcattcaccatcaaacccacccatacctaccggccacccacaagcagcccatagacgtgctccctggccccatagtacaatcgcgccatactcagtgtcgcggcaaagcactaggtcccatcaacagccaggcaaccgcgacggtccaagaatcgaactccagggacgcagcaacaaatgaccgccaaatattacagccccgacgatttagtcacgccacaggaattcgctgatccgcagttcgcggcgatcaaccagaagcgtttcgatctgtacatcgacctgcgcgttcaaggctatagctcctggcgggtcttcagagcgatctggggcgaagagcacatggatggcccggcccaggcccgcatcttcgcgatggagtccaacccgtactatcgcaagcaattcaaagccaagctgaatgcgaccagaacgtccgatctatggaatccaaagacggcgcttcacgaacttctccagatggttcgtgatcccaccgtcaaggactccagccgtctgtcggccatcaaggaattgaacgttctggccgaaatcacgttcgttgacgagtctggtaagaccagggtaggtcgcggattggccgacttctacgcatcagaagccgaggctcagaccgccaccgtcgctgctgcggccgaagccaatggctatgtgcaggacggcgaagagggcgatttcccgtccccgacgccggagccgaccgaggaagaccgcgccaaccccattcagacataaaataacatcgttctaggcccgaataggaccgaactaaggcgacggtagcgggttgggacgaaaaacgattctagggctgttctaggaagccgaccaataacaatcagaaacgacaaagccccggactctagttcagaatccggggctttctttttgggtttcttattctccagcttcgatgatttcgaagttgtatttgacgccttcgtgctcgaaagtcaatttgccggccgctttcagctgcatgcggaagcggatgtgcttcgaagagggcaggccgaactcgatgaatgctgcgttggtggaccggaactcaccgcgcttccctttgacggtaacggccacgccatgacgctgggtgcgctttttggagacttccgggtctttccaggagttggcgatggctgcggacaggtctttggcctctttggccttctctggcgcgttcttcgcctcttcgcgcatcttccggatttcttccagcgcttcctcttcggtgatctcttcctccggcttcagattttcttcttcggccttctcttcttccttcttcttagaagtgcgggttttgtaaaccttggccggggcttcctcttcctggaaagcttcttcctcggccggcagagcgttcaggatggcgaggcagcgacgctcggcggtcttgcgatcagagaagcgattgacagtcgcatcggcgttgtgagcgttgtagaaggcgaccagttctttcatttctgcgttctggatgtcgccgaaggttttgatggagttggtcattttgcgatcctctgttttggaagatttcgttcgggcttcagtttgtcgccccgttgaaagagattatgcctaggtcgatgctgcgtgtctacatttatttcagcataatgacgacgaacccgacgaacggttgtcggatgtgaaaacaccgcaggataggctgcggtgtttctggatgagggagacggtcagaaagtcgggatcgtgataggctcgacgggcagatcgccgggcagatcgccgggcttgtcgttgtccgacgcgggcgacggactggacgggatggctccggaccgaagtcccagcggttcaggccgcctgctcacctgcggtgccggaggcgctggcggagctttcggcactggaggtgcgggcggtgctggtggagacatcggcccttctggaaggtcgggaaggctcggtgctttcggctcgtagtgaactgtcgtgtcgttccccggttttgcgggatcgacgcctacgaacggggttgtgacgcagcgcatgtttggatggttcgccagattcttcagggcgatggagtctgcccagacatacggattcttgtgtttgccagggccgtggctgatgatctcggcaggcatgtggccgttgaggttcagccactccgccatcccttgccgagacagcgggcttaccacgatctggccagtagcctcttcggcaacggcgaacaaatcgccgagtttgaatccgatgatcaaatagttggacctggcctcgccgacgaaggcgacagtttcagcgccatggtggatatcttgatcttcccagatgtatagcatgatgcgccctcagtaaggttgcttggtgtgctcgaccagagacattccggccggaactttgaagcgtatgtactcgatcatcatcgcagtccggcgacgattcgttccggactcgtcattcacgaagagttcgcactggtgcggaatgactcgcgtcaccagcgcttcgcctttcgagccgtagaacttgatgtaggctgcgacgcctcgcgtcatgttcagctggatcgtttcgcagagtcgctgcgcggccgacgcgctggacaaatcggtcgggctgaccgtcacccagtaatgagcatttgctgtttgttctttttcagacatcaatggtctccatggtgaagcctccaccgaatggcagaggctagtcgttagtcgcgcttcatcaggacgactttggtgtactcgacatatttcccgcgccagtcttcccagtagtcgccgaccgggcaggtcaactccagagttacttcaccacgccagagttcgaccgacaggacgatggccctgttccttgctgcgctgtcgggcctgagcttgatcagaatctcgtcgcctgttttcagctcgtccactcgtactacttttgccatgtcgttctcctattcgattgagttccagatgatggttgggtagtccctggcgaatttaatgccgaagtctttccactcaccgcctacgagtgccgagacttcgacacttattttgttgtgcggagcaggactggcgcgcaggactatggctcgacgccgaatggggtcattgacgtccacatgggtgagtatttcatcgccgaccgtcagtgcgcaagccaacaaaatatttgccatcacaacctcctgtgggaaggcgcgcccaggacgatcccgaccgcgccgatggattaacgtttgtgaaggatggacgcagagtccacgtcgatgattttgatggtacggcgacggcgtttgttgctgcgttcgtgaatgcgaatcagattagcggatggagcttcgtccaccacccatacgtcttccggtttctgcgtccggagcaggaccgtcacttcagtattctgggcgaggccgttgcagatgaacgtgaacttggacgagggagttctgtacatttcgagattcctttttggactttgggtccggcttctcagccggtgaagagattatgccctgattctcaccgccgagtaaagcatttatgtatcaattctcccgtcaggtggaaccaaagcgcggtatcgcttatggctacgctaccgcgccatggaccttcttgctcgcacactgcgaaccacaagctgatttccatccttgccaggactcggccgaaagattcaaacctgcgccgactggccaatatgtcgacattcactcgtcgattgatctcgtaccggcgaccgttgatgacgaagaccagacgcagggtttgtccgtcaagacactcccagtatctggtctcatatcggagccaatggcgtttgcctgtcggaccaaccatcgtcatccttctatactcctggctgctccacggggaccggatggtggagtcggatcgaatcgacccaggatgtagtcgggccgacgcgcttcctgcggacagacggcgagaaggcgccatcctgcgtccagggcatgctggagttcgtctgtgcagcagtcttccttgagaagcaggcgattgacgttctggaggtttggaccaggaatagccgaaccggtgagtgaattccaaccctcaattccgctcacgatctgcggttggttgatgtggcttgcggacataccggccaaccggctcgcggccagctccagacgctccagcatgggtcgcagagcggcttccgggtcaatgtcgtcccagagcagaaccagattggtgatggagtatggatagttgctatccaaatcccaggccgaagccgtcaggcgacctaagccgatttcgctacacaccaccgggacgttattgctccaactggacggctcccagttacgctcaccgggagttccgatggttacgccttccaggttccccagaagaacgtggaacttgctgatgtattccccctccagcgctttccgctcttcgtcggtctggttgtggcgatagaaggtcggagggctgatcgtggcctggtagagtttcatggctgttcctttgtgtagatgtttgacttcaaagaattttgtcgcagaacttctcgaaaggactctgccttttcttctcgcacaccgcgcaggtcacttccagggcaggaatctcgttataagtcttgccgaagtacagccagcgcttacacaagcttcgaccgtccgccatgaagaagtgaacctttcgagcagcgccgggttgtgcccagccgctcggcatcttactggacttgttcatgctatctcccgcttcggctcaggaatccatggtgtgatttcgtccacccattccccatcgatgaacgtcaatgacagaagaccatagcgcccgaaactgaagcctacatagaacgatcccggctccacttccatgctggcggtattgcgttcttcgatcatctggaaatcgaacattgcatagctcataccatcaccatgtcgatttcgttgatgaagaagtgtacgtcgacaccatctgcgcggccggtgtaacgcagacgagtcacgccgtcgattttgacttcttctacgccaatgacttccaagatggtgtcattgcagtacagcttgacgaacatcttgatgccggagcctaccgccgcgaaggcgatctgcttatacaggtcttgcttgatcatgctttacgctcccgtttgctggtgtagatggcttcgacttcggcctcaagcttcgcccaaagttcgttgtccaccggaccccatggtccggtctgggtgccgtcaaccggcgcgaacttcccaccggcgcgacgatatttggaaagggtctggagttcgatgattcgccgttcgtaggcgtcgaattgaggtgtcatttcgcaatcctcttttggacgttcgcgtttcgatgaggtgactatatctaagtcgcctcatcgagtaaagcacttctgcgaaattatttgagattctgtaaggtaaggaagccgaacgatttggtcagtcgatggagccgaggctccacccgttgcgggcgaaggccgagcgacccgacagcttgcggcattgaatggagcttccatcgtcgaaagtataggctgtggcccagtccaggcgctcacgacgtactgccgcattggcgatgtcttccagacgggctttaaggagttgctcggctttagtcatctcacacctctttggtttattcactcgatgaggtgactatacctcagccacctcatcgagtaaagcacttttgagagaattatctgaaatttctggaagccaggaactgtcgccagagccagtcaacgtgatcgttcagatagcgctcgccatcggatgacagagacaggcagccgtcattgatgccgagcttggaactggcgatccgttcgaattcgaactggagcgttccgggccgagggatatggtacaggcaatatttctgcacgatcagcagtcctcgaaaggtttacggttcgcaatttccgcgatcctttgcatgccgatgcgatagaattcggcatcttcgcgcgcccgtgacaatgcttcgcgcgcttcgcaagccagcttgtattgattgttggcattggcgatgcttccgtccaggcttctgtcagactcttcccggagcgccttttgggactccagctcggcctccagctcgcggattcgaagggcgagctggctattcgtttcggcagctttgttttccagatcgatggccgatttcgctgctgtttcgagcctgtctttgtcggccatgagggtttccaggctcttgtcgagtgcttccagaagagtcttcttggactccagctccagcgaaaattcgacgttctgcgcggacaagttctgcgagtgcttcagcagttcgtcgattcttctttggtgccccttgatggccgagttctttgattcaacttcggcctccaaatctctgattctgagttgaagctggcgattcacctcggccgtcttttcttcgcgagcgatggagttttgcaggcattcgtccagacgcgagttctcccgatcaagctccatgtccgtcaggctttcgtcagaagtcacgccttcggattcgtctttccgtccctgatcggcccgaagataatactgtccagcggcgaacgccaggagggcgcgattggaaaactcagtagcgccctgcaagtaagaagatttgtatcgaggaacgaactcggccttctcttcgtcccagcagaggctatctgctgtcggccagaactttcgaaactgggaggcgctgacgcttacatccaccaggacgatttctgcttcatctacgacttcgagcttgaacttgacgtcaccgtcgatgctgttgaaagggattagcttggacacgacaattctcctgtgaatggcgcgaccaaccggccgcgcctgatgattactcttcgccttcgtccgcgcgcctgatgattactcttcgccttcgtccgcgctcagccactcttcgaaggcgaaattgaccttagactcgacccaatcttgaagctcatcggcgaactcgtcactgtcgatgtccatcggaatgcccagagtctcttcgttccacagttcggcattcagttcgaactggatagccggttcgccatccacattcagcaggatgcggtctgcaacttcatagtcgtcgacatcgaagaggaaaccgccgctgatgatgtgctggatgaaagcttcgtcgaagttgctgacgccgatatttatctgcttagtcatttttctggccccttatttggcgagtttgtactgagctttgagggtggtcagcttagctttcagggcgatcatagcctggccgcgcaggccttccatttctgcctcgctgatggcgatcttggcggagcggatttgatcgttgatctgggatttggtcatttctgcgttcctctgttttggagtgtttcgcgtttcgatgaagagattatgacgctattcagaatggaagtaaagcagaattgtgaaatatttctcaaagtggacgagcggtctgttcgtcaggaatatttcctaccatggaaggcgtgtccgcatccgaagactgataggtatccgttgacttcggactgtctcttttcggagtcgatttcgatccttagcatttccagctcataccgggccagaccgccccactccctttcgatgcgttcatactcggcttctaatcggcgcagacgttcactcatgggaatctcctttggatagctatcactagcgtcagtacgtacaagtcattt

SEQ ID NO: 5 - DNA, 66331 bp, artificial sequence
  BP1450
tcgcgtttcgatgaggagattatgccgatagtcagaatggaagtaaagtgtctgagtgaagaaatttctgtacaccgacgaacggtcgtgctcgaccgtctgctgcggtgtcgatatactcggcctattgcgaacaatggactgattaaatgtacaaactcaatcctgcgctgcgagcggtctggcgaactcgtgcccgttacaaagtcatctatggcggccgggcgtcttcgaagtcgcacgacgctggcggtatagccgttttcctcgcggccaactacaagctaaagttcctctgtgctcgccagtttcagaaccgcatcagcgaatcggtctacacgttgatcaaagacaagatcgaaaactcagagtataatggcgaattcatcttcaccaagaactccatcaagcacaagattaccggctcagagttcctgttttatgggatcgcccgtaacctgtcggaaatcaagtccaccgaaggcatcgacattctctggcttgaggaagctcactacctgacacaggagcagtgggaagttatcgagccgaccatccggaaagaaaactctgaaatctggatcatcttcaaccctaacgaagtcaccgatttcgtgtatcagaacttcgtggtcaaaccaccgaaagactcctgcgtcaagatgatcaactggaacgaaaatccgttcctaagcgagacgatgctcaaagtgattcacgaagcctatgagcgcgaccgggagcaggccgagcacatttatggcgggattccgaagactggaggcgacaaatccgtcatcaacctcaagttcattctcgcggccatcgacgcccacaagaaactcggctgggagccggccggatcgaagcgcatcggcttcgacgttgcggacgacggcgaggatgcgaacgcaactacgctcatgcacggcaacatcatcatggaagtggacgaatgggacggcctggaagatgaactgctcaagtcgtccagccgcgtttacaacctggcgaagatgaaaggcgcctcggtcacttatgactccatcggcgtcggtgctcacgtcggttcgaagttcgccgaattgaacgatgccagccccgacttcaagctgatctatgacccattcaacgcgggcggcgctgtcgataagcctgatgatgtttacatgaagctgccgcacacgacgatcaagaacaaagaccacttcagcaacatcaaggcgcagaagtgggaagaagtcgcgacccgattccggaagacttatgaagcggtcgagcatggaaaggtttatccattcgacgaattgatttcgatcaactctgaaacgattcacccggacaaactgaatcaactgtgcatcgaactttcgtcgccgcgcaaagacctggacatgaacggccggttcaaagtcgagtccaagaaggatatgcgcgagaaacgcaagatcaagtcaccgaacatcgctgactcggtgattatgtcggccattctgccgatccggaagcccaaaggcttcttcgacttctaaacatagaaaagcccggatcactccgggcttcgggtcttactcggtgcggttcctggcgctgagtgtcgacgcaacggcctcgccgactcccagggcttcctggccggccgcgagcgcttcggcttccgactcgacgatgaaatcatcaccttggccatcgcctggcggaacctcgaccagcacggcttcttcgccttcgaaccgcaggtcataggtcttttcgacggacagaccgtaacgagcgttgagcgcgtcccagagctgggcctcataggtccgcaggtcttgcagagctttctggtggctgagcatggccatgtcaacggcccgttgcagggtttcgtccaggacgttgaaccgaatgcgaagagaacgaatccgctcgacgacttccgcatccactacatgtctttcgatcattgcttttcacctttgctgaatgttacgttgtagccgttgtcggccaggtaggtcagggcgccttcgaaggaagttccgacgaggtgcttgaactgcatttttcgttgcgcggccagccagaatgctgttccggagaactcggcgcggccttcggccaagacccttccatcaggcccggcgatccgtacatggacggaagatagcttgatcggcatcagtgaatacctccactggcttgcgacggcatgctttcagcgcgagcggcttcgcagtccgggcagggacaggcttggcggacgcgctccagctcgtcggcatccatgacatagagcttcccatcggcagtgtcgtgcgccatggcgatgttcgggaagtcggtggcgctcaggccggcgacggcgcggatttcgtcccagagcgccagattctcggcattcaggcgagcggcgagcgcttcgtgctctttagcgacgcgcgccatgaactcgtccatccggaatgcgaattccgcatcgatggcgcgggccgaggccatggagctgagtcgaatcggttctttcttcatggtgattctcttttggctggtggttgttcgttgctcaggcctattacagcatggacagcgtgatgaagatgaacacaaaggctgcaaacgccaatagcgctccggtaagcattttggaatgactctgcacctcagcgtactgcttagtggacattccgtgctgcgccgcctcggccgcgaatctggctttcgcctcgataacttccgggcgcagcgacaggacatattctaaggcctcttcccgcgctttttcggcctcgaccgacctagggtcgcgggccgagacttcgctgtgccctggcctcgcgggatgggcttgcagcgatggaggaagttcagcggccacgactccatagtcggcgcaggcccaagcgatcccgatgaggatcgcgaggatggattggacgattcgcagcataactttgtcgctagggaagctcatgatcaatcctccaccgaccgaacgatttccaggttgcgcccggcattggtcccggcattgaaggcgcgccgaccgtcgctatcgtccaggcgcatgagcttggtgacatttgactccttgtagccaggatcgccgaaatgttcgtgcaccgcagcttccttcaccacaaccagagacgttccggcagaagataccagctccatgcgcttcctggtgatggcctgaaggcgatagctgatttcctgggtcgcggccaatttgaattgcgcggcaaccttgacgttgaaccgtccgtatccttgagccttctgatactccctgcacagacgatcaaccgcttcgacaagggagttgaacatgttcacagccagctcaacgtccgacttgtagcctttgaagcgtacggcatggccccagcgcttggtagtgcttccgtcgcgggcgctcctggatgccttagccgatgctctgtggttgttgatgccaccggcgaaatccatgatgcagtcattgtacgtcgccacggccactgagaaaaacttcatccagttcgggattgcggaatagtaacgagtggcaatttgctcatcgaactcttcgcgaatctcgccggtagcttcgaagtcgtgaaggtcatatttgtccttcaacttcttcacacgctcggctgcgatggccgcttcgtgcggactggaagagtcggctgccatggcggtcagtttgcggatgcggtctttcgccttctcgatggcttccggagtgaattcgttctggtcggtcatggtcggttccttttgtctgaagggtttcgcgtttcaatggagctattctgccttcactcagaatggaagtaaagcactttcttccactatttcggcatcgactggaagaaattccagatccaatcacctgctaccagcaagaggatgagggcggcaaagaacaggacggcggccgcgagctgtgcgcccggcttcagcttgggatggctgagctttggttctgcgggaacggattgagtgctggcgctgcgaccgtcttctcccaggccgtagccgatgccgcattcacgcgcctggagcgacaccagggatttcagatgctcggtctgcttttgcgactcttcgtagatgccggcgacggcgaaccagagggcgaacacgacggacgtacacacaacccaggcgccggtcagcaggagggccagcgggccgatgacgaagacggtagcagccaggacgattgcgccgccccagatgatgaagccggccagaccattagtgatgtcgacacagaactttttcattttcagattccttcggttacgggatggaggggatttgaaactctgcgccgccgagaacatcgatgacgacttcccagagcgtcggaacagaccactggtaacggtcgaagtcggtttcaggatcgacgcccagcgtcacataggaagtggcaggccatttatgaacactgcctttccgcatgagagtcgccacgcggccgtcaccgagcggattcgtcctgtgcggaacgtacgcagacatcgaatattgctgcccggcgtcgacaacaaatctttgcctctggcgcagacatacagagcccacaggattccagccgcgaccgccgcaagcctggcgagccgaagaatgctcataaccttcgtgagtcatttcaccgaggcaagccgagcgatcctcgtaatagttgatgttctccatcgatccaaccagcaccagagactcgaaatcgaatcgatgatcgtggatggccgagtgattgaagcaaagccgacgcggcagctccgggtgccaaacatggaggcgaccggccggaagttggacctgaatgaaccccaggccgtgcagagtgatcttgtccttcatcgggtcatggacggtgctcatggataatcctcagtagcagaaatgtattgtgagagttacgattgacaaaccggtcgcccatagaagggcgaaccaggccatggctttgattgtcgtgtagatcatccgaagaattttccggcacagatcgggccaatgcccatttcgatggatgcgtggttggtcaactcgcgaccgcagcaggagcactgaccagtcttccgaccgtaggcgactgccgattccatcggcttttcgaacatcttcagaacgtcgtcgtgctcagtatcggtgcagtcgcgactcttgatgaatttgccatttgtgatccggccgaggtagatgtcgcccaggacgtacaggctaccggcgttccggctgtgagcgctagcctctttcacaacaacgatgagcggctcctcgccttcgccagctaggcggattttcgggcgcttgataccagactctttcgccttctcaaacgctttctcgatgccggaaatgtccagagtcggcgcagcagcttcctgcgcggccactttctcgcgatacttggcgaggttttcgatggcgcgcttcgcagcagcgatctgattttctgtcaaggagccgtatttatacaacgactcctgaaggctctgagcgaagctgaaggaatttccagtccaccactcgatgatgtccgggtgcgcggcttcgaaggccttaattttgaggtcgcgctcttgcgcagcgctacagattttctcgatgcgcttttctgccgccttagcacggctcttggcgcgctgctccgggctggttttgtactctttgtatccgacgccgccgcaggcaaagcaggcgcgaccataagacgaagggccacggtacaggccggtgcctgcgcatttggtgcacttgtcgcgatacagcttcacttccttccgggagttcgggcgggctcccatggacacgtcttccagcgttttcggcgcttcgtcagtgatcgctacggtagcgaagtcatcgcccaggtcttcgaagccggtgaacagattctctgctgcgttcatatcgattctcctgtttgtaaagttcgtttcgatgagttgactatacgccagaaatggaaaaacggtagcgatttctcactaccgttcgtcgggtcgaaggcaatcaataaatgtcgctattgatcttgaacccatgctcagcgccgtcgttgtagtcgtactcagcatagctgtcgcagtagtcgttcaaatgctgaatgatgcctaggacgtcgttcgcggccttgtgccgtttcgcggctatggtcttggcgatgctgtcgccgacttccagggtttcggccgtccggcgatggatcagcagacgactccaaagatagagccggacgcgacgaatgatgtcgcgatggcgctccagtcgtccgtgcaactcttcaatttcttgctcgcgagatttcaccactcgtcgaagctgctgaacttccaattccaaatcggccttagtagccatgttcacctcaaaaaggaaaatcgtctgggactccaggaagttcgacgattattgttgagcctgatcggtctagaatgcatccgaccgagccagccctgtgtggatagggtctacacgaactataacaggtgacttccctgactattcgccaggtcgatcctccacaccatctgcaaattggcgggcgcttcgacttcagttttcgttcgtccaggacggcgcgtctgtcgcaggaaaggcagcgtgccttaaccgacgtaaccatgggtatagtcgatcattcggatgagctcatcatcctctgattctctcgacttcagaccgcccaaagagtccgactggccgtcgcatttcgcatcgatatccatcgaagacaggaatcctgccgatactgcggtgatatcaactttgtcgccggccttcttgaagccttcgcactcagcatcgagggccacaattgcactcgcggccatgttcacatgactgatgaggtcggggaagatcacaggaacttcacgcgacatgccacggaccgtcagcttcaggactacatacttcatactcactatcccttttgtatgtgaggaaagaacttgctattttccggatggtgaaaatgctcggtcgcaggcggtctttcttccggacactgaatcgtcgaaggcgggaaaaccgcgccggcgataatcgccgcgaggagtgcagcggatgtcgacatccagagggcggtttccaggctcacccgaacttccggacggcgcggcttcattcgctccaccctcttcccggttcataggatggtagactgccgccgcgaacccagttgtcccacatatggttcagaccagtcggtggctggggtggcggactgtagaatccgggagtctcagtgctgctcaggaaataaggcgtgcaaacggcctggacgaccaattggtgccgctcccacatcttatcaatcgctcttagcatgacgtcttcgcactgagccttactgtcgaaccgtctgctagtatggtccggcatctggacgcagccgtctccagtgcaaaggaaagcagtagcaatccatacggtgatactcgccatttcgtcaccctctttagttgatgagcagagtctattccatctgctcgccaggagcaaagcgcttttcgtcgggataaatgccgatgatgtctgcgtcgagcatccaaatctccacggacggatcgtcgctgctgatgtggtacaggttgtacagctcccgtccgccgacagcgcgctcgcctcgcggctcaaccgccagaaccttgccgtgcccttctccgtgctcgtccaggtatatgacgtgatcgccgacttcatagctttctttcgtgacgaggcgtgaacgcgagctgttctgcgattccaccacccaggaatccagcacgccgcctttcatgtcgcgaaacaatcttgccgatttgtcgcaatcgaatacgcccagaacttctccgtctttcaacacgatatgtacgattggcaaaagagtattcatgtttaatctccattggttgataattagagtctaatctgccgaaaagttcccgtaaagaattattttctcataactgattagttgcaactgttaatctgatgtatatgttcgaatctcttttgaacgtttgatgtttcccctataataagcgcacacagccaacaaccacgtggaactacaatgtttaaactttcctggatattcgggcgcaaaaaggataatgctgcctgttctgaatcggcgccggagaaagtcgcacaaatccctcaacacgatccgctcgaccccatgatcaagctgggaaggattcgcggctggaacgtcgagccggagaaagccccggtcattcgtagtgtgaaagatttcctggagccgggcctatctgtcgcaatggatagtgcgtatggtgatggaccaaccccggccgcgaaggctgctgcaggcggccagaatccctatgtcgtcccgactatgttgcaggactggtacaattcccaagggttcatcggataccaagcttgcgcaatcatttcccaacactggttggtggacaaagcttgttccatgtctggggaagacgcagcacggaacggatgggaactcaaatcggacggcaggaagctatccgatgaacaaagcgcgctgatcgcccggcgcgacatggagtttcgcgtcaaagacaacctcgtcgaactcaacagattcaagaacgttttcggcgttcgcatcgcgctgttcgttgtggagtctgatgacccggactactacgaaaaaccgttcaatccggatggaatcacgcccggctcctacaagggaatctcccagatcgatccatactgggcgatgccgcagctcactgctggctcgacggcagatccgtcttccgaacatttctatgagccggatttctggattatcagcggtaaaaaatatcaccgcagccacctagtagtcgttcgtggaccgcagccgccagatatcctgaagcctacatacatcttcggcggtatcccgctcacccagagaatctatgagcgcgtgtatgcggcggaacggacggcgaacgaagccccgctgcttgctatgtcgaagcgaaccagcaccattcacgttgacgtggaaaaggccatcgcgaatgaagacgctttcaacgctcgcctggcgttctggattgccaatcgcgataaccacggcgtgaaagtcttgggtactgatgaaagcatggagcagttcgacacgaaccttgccgacttcgacagcatcatcatgaaccaatatcagctggtcgctgccatcgccaagactccagccacgaagctcctcggcacttctccaaaaggattcaatgccactggtgagcacgaaacgatttcttatcacgaagaactggagtccattcaagagcacatattcgacccacttcttgaacgccactatttgcttctggcgaagtcggaagaaatcgatgtgcagctggaaatcgtctggaatcctgtagactccacgtccagccagcaacaagccgaattgaacaacaagaaagccgctaccgacgaaatctacatcaactctggcgttgtgtctccggatgaagttcgcgagcgtctgcgcgacgatccgcgttccggctacaaccgactcaccgacgatcaggcagaaaccgaaccgggcatgtctccggaaaacctggccgaattcgagaaggccggtgcacagtcgacaaaggcgaaaggcgaagccgagcgagccgaagcccaggcgggcgccgtagagggcgcaggcggcccggttcccgccgctccacgcgcgactaagcctctcgcgaaagcggccgaggaaggggccagcgaggccgctgaaccgccgtcgcgaccggaccccaaggccgagctgcggaacttgttggtcgatcttttgtcgaagctccaagacctggacgacattaaggcgccggacggcgtagacatagagcacaatgatgcgcctggcttaaagcgcacgtcccaacctggcgtgtctggcatggagccttcggtgttttcgtccaaccgcatcatcgggcctcgtgatcattcggaactccagagaatcaaggtgaatggaataaccaccttgatcgaaaatccgcgcggaagcattcggcaaggaaaggatgggagttggcgagttcagatgaaacaccactacgggttcatcaagggaacgaaaggcgctgatggggatgaagtcgattgcttcgtcggtccgaatctgggatccaaacgggtcttcgtcgtcaaccaagtgaacaaggaaggtcagtttgacgagcacaagtgtatgctcggcttcaacaacatcaacgatgcgaagtccggatatctgtcctgcttccgtccgggctgggatggtctcggctccatccatgaagttgacctgcccgctttccgtcgctggctggcgaacggcgacaccaccaaaccattcgggggcgagtgatggcattcaaggcctccaaaaagcgcgagcgccgggcacctcttccagtcggaagagggaagcccataattccatcggcaggaatcgaggcctggtatcgaaagcagatgaaggatatgtccaagctcatgatctccgactatcgaaacgagattgagaaggcgctgtcccagcctgcggccgaacggttcttcgccagagacgaatccgttaacgtcctgttcaagatgacccttcgaagcctacagcagcgatggagccgcatttttgaaggtttcgcggccaagatcgccccggagttcgtcaaccggaccgaagaagccgccactgccgcgacccttcacagcttgtcggtggccggcgtcgatcagccacgagctgcgtataatgagagcgtcaggaacaccctggaggccgcaaccacttacaatcatactctcatcaccaagatccaagaggaagtccacgagaagatttacacatcagtaatgctgtctctgacttccccgaatccggaagagcaaggaacttccggcataactaacgcacttcgcaaagtcgggaagttttctgaagatcgaatcgaactcatcgcaagagatcaaacaagcaagctttacagttctctgagcgatgagagaatggcggaaaatggagtcgaggagttcgagtggctacactcttctgccggcaagactcctcgccacacccacctggagaaagatgggaagaggttcaagctgaatgaccccagactttgggagggtccgaaagcagaccaggggccgccaggatgggcgattaactgtagatgcagaaagataccagtcatttgacatcgataggagcgctatatgccgttagttcatggcacttccaatgaggctcgttctgaaaacatcaagcgggaaatcgaagccggtaaagacccaaagcaggctgcggccatcgcttattccatccagcgcagtgagaaagggaagacggcgaaagattgttcgcctgagctcgtcgccgatcttcgcgccctggtggacgctctgtcgaggctcgtgaaatgaaccgcaagacgtgccggcgccgactcgtggtcgatgtaatcagggccaatattcacggcggattcttcagcctgaagtttgccgccatcgatttggcaatcatcggcgtcgccatcttgatggcttttggccgataatgctgagaaaaatctggattctgactaaaaattctagtccggatagccgcaaattaccgtttacggaaaatagcagtaatttggaaatcctactgccgcgaggctttaacagagccagttcctaatttccgatttagccgcatgcttcaaaagtatatagcctgggaaattagaagtaacgttccaatagaattcatctataagtaacgttataatataacgtcaatctatatactctagacgtattgaaattcaatttttaatcggtaaattggtaatttgaattagtttaggagttgaaagccggaaattagaagtaacgttccaatagaattcatctataagtaacgttataatataacgtcaatctatatactctagacgtattgaaattcaatttttaatcggtaaattggtaatttgaattagtttaggagttgaaagcctcgcggcagtaggcttagacaaatcccgtcaagtttccgagaccaaattaccggattttcgcggctgaggaaactggtaattagatcataatacaaattataatgtaagttaacagtcacggctacatctaattattgttccgcttatttacccttagatgtactgcgtatataatacagccatagtccacgactcttcgaattaacgatggcaaagtcgaaaagaaaaattgacgaaaatggatatatgaccatagagggctgcccgatcagctcttatggcgttttccaatattctgctggtcaactcggtcttccgggcgatccgacgcggattgtcaacgtatatcgcccggagtctgccgtcagcgatccggagtacatcgaatctctgaagaatctcccgttgatcgacgagcatgagatgctgtcgggattcgacgatgatgacgatagcgtggcccccgaagacaaaggggtggagggcatcatcacatccaacgcttactacgaagccccatgggcacgcggcgatatccgcatctattcccgcaacatgcagaatcagctggaaaggggcaaagaagacctgtccctaggctatagttgccgctacactgagcaacccggcatctggaacgggacgccttatgaagtcgtccaggacaagatgcgcggcaaccacatcgccctggtaaaagagggtcgtgtgccgggggccagagtattggatggtctgtgttttgaccatctcagttttgatttcagaccatccgatgagggtaatgaaatgagtctcaagaaagccaagcggaagccccctgtccagcgcgtagggcaagctgctgactcggcggtcgaagagttgcgcgccctgtggccgaagctatctgcgtctgtccagaagttcctgggcgaagaagagcaggagccggagcatcaggaaggcgcagctccggccgaaccaaccgacagcgagcacctgaccgagcatccgactctggaaggtgctcagaaggatgacgaagagcaggaagaggagcctcccgttgtcgatccggccgtggccgccgtcgagccggagcatcaagaaagcgccgcatccgaaatgtccggtgaaggcgaagtcgccgaactgatctctcaggtcaaagccattctggctcgactggagggcacggtagccgaaggggcagacgaagagcatggcgaaggtcaagatgtcgtcgagggcttggaggagcagagcagcctcagcggctcgcaaaccgccagcgacgatggtggtgagagcaaggataacagcgaggaacttcctgaaatggcacagaagaacgcgcaagatgctgcaattcgcggtctctatcgcgacattgctgctaaagatcgcctctacaagcgtcttagctccgtggttggtgcgttcgatcaccgagctatggactcggctgaagtcgctgtttacggcgtgaaaaagctgaacatcagctgtgcgaagggccaggaagctctggcgctcgacatgtacctgaaaggcgtcgaagcctcgcgcggcgcggccagccgtcaatcgaaagcccaggattcggccggttctgctccgcagtgcgccgagctggacagctacctgaagggggagtaactcatgttccagaaacaagtttaccgccagtacactcctggttttccgggcgatctgatcgaggacggcccgaagcgggcgcggccgggtcgaatcatgtctctgtctgccgtaaatccggctgccaccgccaccggccccaaccgcatcagtcgcgctttcggttacgccggtgacgtcagcgccctcggcgaaggtcagccgaagaccatcgcggctcgcgcttctgaagtcgtgatcggcggcgccaacttctttggtgtcctcggtcatccgaagcactatgcgctgttcggttcggccggagactccctggctcccagctatgatctgcccgatggcgccgaaggcgagttcttcgacatggccaccggcctggtcgtcgaaattttcaacggcgccgcaaccgccctggacctggactatggtgacctggtcgcctatgtaccaaacaacctgcctaccgccgacaacgcgcttggcctgccggccggcgccctggttggcttcaaggccggctccatgccgaccggcttggtccagattcccaacgcacgcatcgttaacgccatcagtctgccggcccagtcggcggggaatctggttgctggcgttaccatcgtccagctcacgcagtaaggaggcgtcatgagccagatcagcaagacccattcgcgcctcgcaggccgcaatgcgaaacctttcgacctgaaaaacatcaccaatgacgccgtggcgtctctgcgccgcatcggcctggtattcgatcacgccgtcgtccaggaccagatcaaggccttggcgaaggccggcgcgttccgctccggctcggccatggacagcaacttcaccgccccggtgaccacgccgtccatcccgactcccatccagttcctgcagacctggttgccgggcttcgtgaaggtcatgaccgctgcacggaagatcgacgaaatcatcggcatcgataccgttggctcctgggaagatcaagaaatcgtccagggcatcgtggagccggccggcactgcggtggaatacggcgaccagaccaacatcccgctgaccagctggaccgccaacttcgaacgccgcaccatcgttcgtggcgagctgggtatgatggtgggtaccctggaagagggtcgcgcctcggccatccgtctgaacagcgccgaaaccaagcgccaacaggcggccatcggtctggaaatcttccgcaacgccatcggtttctacggctggcagagcggcctgggcaaccgcacctatggtttcctgaacgatcccaacctgccggcattccagaccccgccgagccagggctggtccactgccgactgggcaggcatcatcggcgacatccgcgaggccgttcgccagctgcgtattcagagccaagatcagatcgatccgaaggcggaaaagatcaccctggccctggccaccagcaaggtggactacctgtcggtaaccacgccttacggcatttcggtttcggactggatcgaacagacctatccgaaaatgcggatcgtgtcggctccggaattgtccggcgtccagatgaaaaaccaagagccggaagatgctctggtgctcttcgtcgaagacgtgaacgcggccgtcgatggaagcaccgatggcggcagcgtgttcagccagctggtacagagcaagttcatcaccctgggtgtcgaaaagcgggcgaagtcgtatgtggaagacttctccaacggcaccgccggtgcgctgtgtaagcgtccgtgggccgtggtgcgctacctcggcatctaaccgatgcctattcaccaaaggccgggtttccggcctttgttcactctgactctgactcggttgtaggggccggttagggcataattactaggactacgccaatgactgtttatatcgtttcctccatgactcaatcggtgtcttacaatgcgtatgacacctctgatccgtccaatcctcgcctccagcgaaagattctgattcgcggccgcgcaggcatcgcatccgaaacttccggcttcggcgacatgatttccgacgaggccggacgtccgatctggaccccacagggcgattgtactgccgtgagcgattcggatttcgagctgcttcaggccaataagattttcatgcgtcacatggagaagggttatctgcgagtcgtgaagaccgacatcaccagtgaccaccagcggatttccaaagagactcgcaccatggagcgcgatggattccagcctctggatgctactcgcctgcagcagaaaatcaaggtgaccacagccagcgcttcccaggaacaagagttccggatttaaccgagggtttcggtatggtgattttcgacgaacataagtttcgcacgctgtttccggagtttgctgatccagccgcttatccggacgtgcgcctgcagatgtacttcgacattgcgtgcgaattcatttctgatcgcgattcgccataccggattctcaatggtaaagccctggaagcctgtctgtatcttctgaccgcccacctcctgtcgctgtccacgatgcaagttcagggcgcggctggaggtggcgtcactgccggtgggacccagggcggtttcatcaccagcgctactgtcggcgaggtcagcgtggccaagctcgcgcccccggccaagaatggttggcagtggtggctttccgggacgccttatggtcaagagttgtgggcgctcctcagcgtcaaagcggtgggcggattctacatcggcggtcttccagagcgccgaggcttccggaaggttggagggacgttctggtgatccctggtgcgaatcttctgcgaatggccttcggggtcatcggtactcaaattgtgaaatatcgcaagtttgagcagcgagtgaagaatgatcaagctcagtacgtttccatgttcgaggagcctttcgacctggcagcgtctgttcagcgagtccgacgcgatcagtatgtccagtttaatctggagttccaacggaattacgttatgatcttcgccaactttgagatggttgacttggatcgcgatgtggccggtgaccagttcctctggaccggaagagtctttcagctggagtctcaaggctcctggttttatcaggacggctggggagtttgcctggccgtggatatcggtgcggccaagctcactgatgacgggaaaccgactttctaggtgatgtatgtttgacggcgaactgatagcgaaactggttgtcgagttgaatgcggcgatgacatctgctcaagaggctttgcagttcccggattttgaagtcgtccagaaagctcagccgacccaacagggaacgtcaaccaggccgaccatctttttccagaaactgtttgacattcctcgcggctggcctgccaccgattggcacctggacaacacggcccgcaaatatgtagaaataactcgacagcatgtagagacgactttccagatcagttcccttcattggcagaatcctgaaataactcacgtggttacggcttctgatatcgccaactatgtgagggcttatttccaagctcgatccacgattgagcgcgtaaaggaactggacttcctcattcttcgcgtgtctcaaatttccaacgaagcattcgagaacgacaatcaccagttcgaattccacccaagttttgacatggttgtaacttacaaccaatatattcgcctgtacgaaaacgcagcatattcggccgatggggtattaataggcatatgagtctgaggcgcgattcagagctaatcgccgcgcacctccagatgttaagagccatgcgcggcaggtccgtttcagccggatggtattccacggctcgatatcctgacaaggcaggcggatcggtcggaatacaagtcgcgagaatcgcacgtctcaatgagtacggcggaactatcgaccatccgggcgggaccaggtatattagggacgccattgttcggggtcggtttgttggcgttcggttcgtcagaaacgactttccgggagaaaccgaggtaactaagcctcacagaattaccatcccggctagaccgtttatgcgatatgcttggaacttgttttccgcagatcgcgccgcaatccagaaccggatagccatgaggctggccagaggacagatcactccagatcaagctcttgcccagatcggcctggcgttggaaggatacatagccagaagcatcaggaccgggccatgggtggctaactcagcatctacggtcaggagaaagggattcaacagaccgctggtcgatacggcgcacatgcttcaatcgattagcagcagagtaacataaccaggagatcatccagtgatcagtcagagccgttatatccggatcatttcgggcgtaggcgcaggcgctccggtcgcaggccgaaagctgattctgcgcgtcatgactaccaacaacgtcatcccgcccggaatcgtcatcgagttcgacaacgccaacgcagtcatgtcatacttcggcgcgcagtcggaagagtatcagcgggctgcggcttatttcaaattcatcagtaaaagcgtgaattcgccgtccagcatcagcttcgctcgctgggtaaacaccgccatcgcgccgatggttgttggtgacaatctgccgaagaccatcgccgatttcgccggcttctcagcaggggttctgaccatcacggtcggcgcggccgaacagaacatcaccgccatcgatacgtccgcagcgacttctatggacaacgtggcgtcgatcatccagaccgaaatccgcaagaacgccgacccgcagctggcccaggctaccgttacctggaatcagaacaccaaccagttcaccttggtcggcgccaccatcggcaccggcgtcctggctgtggcgaaatctgccgatccccaggacatgtccactgccctcggctggtccacctccaacgtcgtcaacgtcgccggccaggctgccgatcttcccgacgcggccgttgccaagagcaccaatgtcagcaacaacttcggttcgttcctgttcgccggtgcgccgctcgacaatgaccagatcaaggccgtgtcggcctggaacgcggctcagaacaaccagttcatctacacggtcgcaacttccctggcgaacctcggcactcttttcaccttggtgaatggaaacgccgggaccgccctgaacgtgctgtcggcgactgctgccaacgacttcgtggagcagtgccccagcgagattctggccgccaccaactacgatgagccgggcgcttcgcaaaactacatgtactaccaattccctggccgcaacatcaccgtttccgacgataccgttgcgaacaccgtcgacaagagccggggcaactacatcggcgtcacccaggccaatggccagcaactcgcgttctaccagcgcggcattctgtgcggcggtccgaccgatgctgtggacatgaacgtctatgccaacgaaatctggctgaagtcggctatcgctcaagcgctcctggacttgttcctgaacgtcaatgcggttccggcgagcagcactggcgaggcgatgaccctggcggtgctgcagccggttctggacaaggcgaccgccaacggcacgttcacctacggcaaggaaatcagcgccgtccagcagcagtacatcacccaagtcaccggtgatcgccgcgcctggcgtcaagtccaaaccctgggttactggatcaacatcaccttctccagctataccaacagcaacacaggcttgaccgagtggaaggccaactacacgctgatctattcgaagggcgatgccatccgcttcgtcgaaggatcggatgtgatgatctaatggtttgcggcggactcgatccgccgcgaccttccataaatggagtgaggaataagcaatgatcaacatttctgcgttcggctcgatctgccagttcacggcaagcagaactttcccgaacggattcaccgtcaccgagtttgccgacgatgcggaccccatcgacagcccgccgttcactgcggccgataccggcgtcggcctcaacggtgacatggtagtctggaaccgggcgaacatcctggaagtcgtcgttaacgtcattccgaataccgagggcgagcgcaacctggcagtcctgctggatgccaaccgcaccggaaaggacaagtcgggcgctcgtgatgtcgtcggcctggtcgtggcgatgccggacggcagcaaaatcacctgcaccaacggcaccccaatcgacggcgttctgatcaacgcggtggcaagcgtcggccgtctgaagaccaagccgtatcggttccgatttgaaaaagtgatcaaagccggtactagctgatgaagaaaattccgctgacagcagtccccaatcaagcgatctcatttaacgccggtagcagctattggaagattcgcctgtaccagaacatggacatgatgaatgccgatatcagccgcgacggcgtgatcgtttgccatggggttcgctgcttcggcgggattcctcttctccagtacagccatcagtaccgacctgactatggcaatttcgtcttcgaccgcgacgccgattggacattgttcggcgacggcatcaacctgttctatctggacggcgccgaattcgccgagtatcaggcgcttgccacgaggaaagaatgagcacatcaacgatcagaaccgggacgaacaacgatatccttttggacgacaatggaaacatggttatcctcagggatgtcgaagcgtgcgcccaggacgttcgggcggcgatgctcatgcgcaccggcgaaaacattttcgatgtgaactccggcgtgggatatttcgaatacatcttctcgccgcagaaaagctatgatgacgctcgcaaatccatcgcggatgcaattttatcctcgccggatgtgaccggcatcgagcagcttgacatcgacataaccggggaagtcttcggcgtcgatgcgaaagtcatcaccatccacgggcctgttaccacaggagtttgaaatgagtaccatccgcatccaatacgccaacggcacccaactgttcctggacggcaaaaatccgccgcccctggacccgctgccctcgtttaacccgtctgtcgaagatctggaaggcctggaccgcgaaaagaacatcgacaagggcgactcctcgccggccggtcttcccgttcccccggtaaacgtcgattccaatgtcgacaacggcggaaccatcccggctccggtatcgaccgacgctgccgcggccgaatcggccccggaaggagcccaggaagctcctgcagcaggccaaggcgamgagaaaggcgccgaggaagccccgactacagcccctgtagaaaaggccgaggaaacggcctcgccggccgctgaagaggaaaccccggctccagccaaggccacctctcgcaaaaccaccagcaagtaaggactcgacatgatcaacgtcagcggcttcggcacaggaattgtaatagtttcagcctcatcgttcccgatggggttttccttgtcgaagttcgctgatgatgagagtccgatatcctccaaagagctggagccgttcggatatgagatgctttatgacggcggcctattcgcctttgacaaggctgctcctctggaagtatctgtatccgtcatcgcagggagcgaggatgatattaaccttcgcatccttctcaattccaaaaagggatcattcagatttcttccgggcatcatcccagatatgacgactctcgtggccactcttcctgatggcggccgcaccgttctgtccaatgggactatcatcaagggtccggccatcgacaccatacagaacaccggacgacgcaaaggcaacacgtacacttttgtgttcggtagctatcttggcgcccagactgcgcgtcaagccatttctaacgttatccaatcggtactggaggtggtctgatgttggggattttcaccagcctcctaagttcgcgatctttttcgattgtggaccaaaacacaaaccagctagttgctgcggatttgaggataagccgggtcaacgcccggttttcttctgtagggcaacgccacatgctggaagatggtacgaccaagatggattccagaacgatccaccctatggaaatcatcgtcgaagtattttgcccttcaattgatgtcgtcgatcagatcaatcaattgctcctggatcgcgacacactgtacaaagtcatcactcgcggcatggtatttgaacggatgatgtgtaccagcgaagcgctcaatcagactccggatatgatatcggcgactcctgcgcgcctgacattctcccaagttctcgtccagaatcccaagcctataatgttcagaaatgcaggggactcttctatgatcgaccgagggctggccctagctgaagacgtggttggctcggccggcgatctgttcgactacgcagtaaacggcgtccagaacgccgcagacttgttctgaggtgccaattgaactctttcctcaagtctattctcaacacgcctactctcaccatacgcgatgatgtcaccaaacttcctgtctggaagagtcttcaagtcaagaaagtggaaatttactcgccggcttccgtagtgtcgaaacctctggcgacgaaagaccagacggaagctcaagtgtacaccgaagctctggacattgatgtgaagaatggaaagatcatccaaccggtgcgactccgcatcaatgctatctgtccggacctgtccaccgttgaaagtatcatgaacgctttcaatgataacacctcgactttcgctatcacttctaagtcgatattggccgataaaatggccatcatgacgctcgatgtagatcagtcgccagacatgttgaacgcggctgagatcaatatggaattcgagcaggttgagcctccagtattgaatgaattcgatcctgcgttccctcaagatagtccgacttatggggtacagattcaatctctttctgatgctaatttgctggatttgggcgccatcggcgattcgatatcttcggccgcaaaatcgctatataatcgcgtgaccagctacttctgaggatgtatcatgcttgaaatcaatcttcccgatggccgtcaaactcgcgtacaaatcgaggcgtggtcggcattggatggctgggaactccagcgccgtttcgtcgaattcgctgtcagccaagattccgacttccgccgctctttcaccatggaaatcctgggctatgcgaaagtgctgcttggcgacgatgatgccggcattccgctgaccaccgcggcagtcatcaacaaccacctcggccactggaagaacgtggaactggttttcaactctgttctcaagcacaatggcatcgacccggccacgcacgccgaccggccggactattgggaacaagtcggatcgcagatggccatcgcatttctggccgaggcgtccaagctcattggtccagcaatgaagatcgccgaaggactcgccaacaagccggagtgattcatgtctagtgatttggatgaattcatacttcggtatgaggccgatactgccagagccgagcgcaatctggagcgcctccagaaccagatcaggcgcgtgaacagcgcatcgacgagtggccttcaggatttgcgccacttcgcagacggcgcggcaaccgaactcggccgagtcgttccgcagattgattctgtgacgagcgcaattcgcggaatgaacgcgcaactggcaataggcgccactggcgtggccctggtcgcggccggcgtcaaggcgttcatgaacaccagggaccagtacaatcagcagcgcatccaggcgatggacatcggcatcgccccggcacgcttggaagagtaccagagaaaattcgttcgccagtccggtggaaccatcagccgcgagcagggcgcggagatgaccaaaaatctggcagacactttccggcgtgcttatcgcgatatcgggcgagtcggcccggaagcgcgaattctgcgtatggcaggcgtcgatgtcgggagcttccaaaagggcatgcggccgctcaacgacatcattactgatctggccacgaaaatggccaagttgaagccggacgaaatttctgcctacgctgatgcccttggcgtctcgcgagactacctgagcaccctggcgaagatcggcccggccatgggaaaagtcactgagatgacgactgcggaactccagtccagggtccagggcgagtccaacatccagaaattcaacgatgccctggcgaatctcaaccagacgttcactaccctggaaaaccgagtcggcgaaaagctcgcgcctgcgttcaccaagctgatcgaaatcatcgacaagatagtacaggctattcccaatgaagtggaaagcttcgcgaaggacaccaaatcccgttgggaagatggagtgctcgggaaggcgaccgttggcagtgatattctatccctcctcagccccggcgccctgctcggtcgcctggcagcgtgggggactcgtcgcggcatggaagaatcagggctcatcgacaaggacaaggttcccggcgctcaaaccagcgaagacctggccaagaaacaagaagaccaggacaaggctactaagtccatgaaagagctagagaagctggctgaccagaccacgaagtctaccaatgattttgcggtggcgatcaacatgttcagtggcgcggtatcgtcgttcgcgaatgccgttgacgagcgccaagcttgggcagcctgggcgggggaaattggtcgggcggtcggtatgggaagcaccgcgccgacttcgcgggccaccggcgtctatccgcacgcgatctatgatcagtcgaagagtggcgcggccggacaagtcttcggcgagccaatcggcgcccagtctcttcgcaatcgcatgttctcgccgcagcgcaaggcagagcctgtcaccgttccatcgtacatcaacgatatcatcaaagatgcttcgaagatgtacaacattcctgagctggacatcaagaaactcatatacaccgaaagccgattcaacgccagggccaccagcgaagccggagctaaaggcctcatgcagctgatgccggaaatcgccaaggcgtatggtatcactgacgtatatgaccctcgccagaacatcctcggcggaacgcgcctactgcgggaaaacctagatcgagcaaatggcgacatgcggttggccttgacatactatcatggcggactcgatccgaagaactggggtccaaggactcgcgcatatccgggtttggtaatgagcgctccaatcgagctgatggaagaggctcagcgcaagcagaaggctgcggccatgaccgtcgccaacgagacgttcgccccggaaggcggcgacatggacattcgtccctatgatggcgggcgactggaaaccccagaccagggcaagaaggaagatgagcgccgcgaagcccgtcgatatgacgacagggttgtgcgaccggaaattcgcatcatcgaccgcatgccagaccgcagcgacggcgaaatccttaagatgtctagacgtcaagaggccgaccgggcagattctggattccggaagttcccgaatcaagttcgcggcgagaccaagcagaacatccaggctcaactcactgcaggagccatcgcgcaagtgatcggcgttaaccccaaccagatcatgcgccgcgaaatcagccgttctgacttgctgttcggatacaaccaagccatcctgggcaagcaacaggagatcaaggccgccgcgaccgaagccaacaacgtattcctgtctccagccaagcttgccgaagccacggccaaggtgaacgccgcatcgcgagaaatggatattctccggacgtacggcgagcaacttctgaagagcgctccagagcgcggccaggagctgaccatcggtcgaatcgacatgttggtcaatgtcaccggcgcgaattctccggaagaggctcgcgagatattcagcaagcagactgcagaccagcttactacggcaatccaggacgcccaaaacgattccgcaactaagatactctactgatgaaaaagagaattctgcgagtaacattcaacatgccttatggacccgaagtcatccgcgaagatctggatgttcgggtccggattatgaaggctgcgttgcggattcagaaccgggcgacgatggaaattttcggcctcaccactcagctgcgcgagtctcttctgtcgcagttcaccgcgtggaagcaccggcaacgtcaagtgggcatggaagatgaattgatgatcaaggtgtcggtggaagccggctactctgaccaggggcgcgagcaagtttccagagtttttgtcggcgaagttgccattgtcgatatcatttctccgccacctgacattggaatccgcatccagtgctataccaggcaaatcgacaggacgaagaccattcggaatatgccgcccgctaacacgacgtttgtcaagttcgtcgaatggggcgcgaacgaaatgggattgaacttcatctgcgataccagttacaacgatcaagttctgaagaatccgggccggtctatcactgtcgcgtcggcaatcctggcgtcgattcaggatatgtacatgccggacgtggccgcgttcgtcgatgacgacatattgatcgtgaaggaccgcgataaagtcattcgtccggatgaggtgaccaacgtcaactcgtttgttggaattccatcttggtctgaatggggcgtggaattccagtgtctgtttgagccatcgattcgtgtggctggaggtgtagcggtcgaatctctcatgaatccaagcgtcaatggtaactatgtaataactgctctggaatacgatttggccagtcgggatcggccgttctatatcaaagtcatggggagtccagcggcataatggccagagaaatcaaatcattcaacatgttcggagtccactatacttcgcggcaattctctgctgtcgatgggctcagcatgatgtcggaaattcagagcgtgcagccagaagaattgctcaagggcaccgatgtattggcgcatccggaagaccatccggaaggcatctggcttccattgactgctgcgaacatcaatctttatgtcgttgatcgagcgaaagtaatagctcccgtacaagttcttgcacttctgtccgaagtggtaatcgactggaactttggttttctcaaagactggaccggagtcaagattccatccagatttgtcgaagatatcaaaagcgtgaagacggcacattcaccttctgtagttgcgagcttggtcgcgaacggctcagcctctatgcgcgagttggaagagtattattcgactcaagatgcgttcaagatgatagacatcatgacggcgaagagcgtgaacgaggccttggcgtccgaagcatcgcacaacagaatcaaaaagggataattcctaaccgggcctgggaaggctatactagacctgccaaatcagaggctttcccatgtccaatatttctctaacatccgcaaaagctcccgacaggacgcgactgatcgccgctcttgacgctcggtcgcggcgggatgctctagatttcgaagtaatgataccggctcaggttgttcaatatgacagggccgagaatatcgcgacgattcaacctctcatcacctgggttgacacggaacacaacgccgtccaaaggcatcagctggttgatattcctgtaatttccatgggggctggcggcttccacataagtttcccgattcagcaaggtgacataggctggatttatgcggccgaccgcgacacgtctcagttcctggagtcgttgtcaatgtcgaagccgaacaccggccgcatccataagttcgagcatggcctgttcatcccggacgtattccgtcgatacaccatcaattccgaagattcggccgctatggtcatacaatcgacttccggagcgaccagaatttcgattcgcggcgacaacatcaagatcactgcgccgtcgaatgtcaccgtggatactccgcaggcgaatttcactggaagtgtgactatcgccaacaccctggttgtaaacggcgtcaacgtgaacaaccacggccacctcgaaaacaacccgcctgatgcccggacgaaaggcggcatgattgcttaaggagattttcatggcaagttttgatttttctgatttaacagcgggggggggggttgtaatggctaactacaactacatcgtcgatactggtgtgatagtcgcagataccgccgacgttctgagcgacgttgaggccgagttccgcgccgccctcggtgccaatatcaacttggccgcgagcactccgcagggatcgcttgtcgcggccgaggccatcgcccgttccagtgtcatgcggaatgaagcgcgaattgccaataccataaacccgaacgtttcattcggaacgttcctggacgcgatctgtgccttgatggggatcgagcgcggttctgatctgtcaaccttcggctatggagttcaagtcaccggccgcagccaaacccgcatttccaccgggtctagggtccagactccggccggcgcgatcttcacagtgatgagcgatgtcacgatccctgctggtggtgtcgcgaccatcgatatcaaatcgcaggagtatggcaacattcctctgccggtcgggaatctaatcatcatcgacggaacaattggatggtccggagcaaaagtcatcgcctccactcgcgtcgatccgggcagccgccaaatgagtgatgcagagttgaagaatgcccgcgttaatcgattggccatccaaggccgcaactcgactatggccatcaaggcgtatgtgagcgccgttccaaacgtcacgtcggtgaacgtaatcgagaacaacaccggcgccgttcaagtggtgaatggagtctcgtttacccttccgtatgctgtttgggtctgcgtcgccggaaacccggataaacaagcagtcgccgatgcgttgtgggccgcccataacggcggaactccatgggactatggtgcgacgaacaacggcgtcccggtggacggtccgaatggcgttcctgtgcgcgatccggcgtccggtcgaaagtatgtcgtgaagtggaccactccaattatgtacgatggatatgttaacgtaacagtccagcaaggttcctcctctgtagctccggaagccattcagaacgcagtggtcaattacgcccaggggaaagtggaaggggaagaggggctggtggtgggcgcgagcctgtcggcattcgaagtcgccggagccatcgctcgcgaaattcccggcatctacatcaaactctgccaggtcgcgtgcgtcgcggctggctcgccggctccggctccgggcgatttcacttcggaatacgtcatgagcgcattcggccaggctaccatttccgttggtaacgttcgggtgactttcgtatgactctgcctgcgtacaattcggacatccaacaagctctgaaatggctccataaccaggcgcctggagtcaccggcctgatccagagaaaggcgcaatggtatgacagattcagccgccaattctgggccaactgggagcgcgatgttttccacttgaaaactgccaacccgttcggccttatggtctggtgcataatcctcggcacgccgtcgaaaggctttggtctgtatccgaaaaacagctcttgggcgttcggtcggcttcgccagaacttcatctacagcggtgcgcaagtgccgccgccggccgacgcttcgccgggcggcaacttctacggcggtggcaacgccgaaatcctcaacctggacgagatcaggaaagtgctacagttgcgatatgtagcgctgatttcgaacggctcgattgcttatatcaatcgaatgttgaagtacatcttcaatgatgacgagccttgggatgaggcggctggcctgtacttctatctcatggacttgaccggcgagaatggccctgtggagaacttggcaatatatcggaaagattgggaaggtatggtgttgttgtccagttcgcccagaacgaaccacgtgctgacatcgacccctgccagcgacgccgattggccgggagtcgatccggccgcgagcggtattccggtaacggtcgaaacggcgtccgctacggccccggacggctccgctacggtgtgcaagcttactaagccggccgggagtaccgcttacgtctccgcgccgatagatgggccgctggggtccggtagcactgtaacgttctcgttcttcgcgaaagccggctccacccgtttcattgcaattcagtcggctgccgatttccccagtcgagccgatgccgttttcgacctggattccgggaacgtgatcagcgatcagatgttggacagcagcgtggtaagcgcccgaatgattcgtctggaaaatggctggtggcgttgcgttctcacgaccaagaccgtcagctcttcgttccgcgctgcttacgtcgctccggcagaaaccaacttcagctggattgattcgaattccagcgcggcgattgacgtgcttatctggggcgctcagatcgaactgggtgatactccaactggatacttggagactaccggggcgcccgtaaccatcactgattatgttttgcagaacgcccagaccggaacagtcaagttcacacagccccttccgaccggagtagaagcgtattggactggagactggaaaggcgggtctgcgaccgagccggccagattcgcagtaggggatgggactcaagatacattcaatctgtccagccctgcatacatcggcctacccactagtggggcgttcaagctagaatacagagttggtccggcgcttaatttgtcgccgcaattgatcaacctcatgaatgaccgggcggtcggtatcatgccgacttgcgccggttgcgatgtaaaagtcattcaggagtaatgacgtgatcacacccgaactgatacccagtccgtttgctgcgcagggcgacaaagacccgattccacaaacctcctccactggcttcgcaaaccttcgcgacggctatacgccggactacgaaatcagcctggcgtcgaacaacccgcaggccaaagcggtcgagcggaaaattcaaaaccaactcttcttcatcgcgacccagaacgcacaggcgtggcagcgacaaatggcgccgccgtggtttcagggcatgcctggcggctacgaacagaatgcagaagtcgtgcgcgtcggaaatgacggcataatgcggcgttatcgttccatggtgaatgccaatgcgagcgaccctctcagcagcacgacttgggaagaacaacccgcatggtcggcgatgcgctccaacatcccgatgccggccggaggcccaggcctatcttctggcggagaagtcatcacgaccggccgcaacttcaacaacctgttaaatgggacgtgggagttcttctctgattcagtggttatcgcttctcagaatgcccccgtatatccggcttccgctggtgccgctgctggcatgttggaggcgaaatcttgggtgtccggagccaatacgttctgcgtccaacgctacactgatcgcgtcgggaacgtcgctgtgcgcgggcttaatgccggagcgtggaccaactggatgtatgcagtaaacgtcatggcccttcaacaaggtcgggtcacctatggagtcgcggccggatcggcgaacgcttacacgttgacgctagttccgcagctccaaggcggcctggtggatggcatgattcttcgggtcaagttcaacaccatgaacaccggcgcctccaccatcaacgtctccggactcggcgccaaagccatcgtcggcgcggccaacttccctctcaccggcggcgaacttggccaaggactcatcgctgagcttgtattcgacgcagcaggcgaccgctggagaatcctcgcaggcgcgccacgcatccaagttggcaacgccgatcaagattaccaggcccccagctggaaacaggtgaaggattacgtcgcgtcccaaaagctgactgaagtggactgggctgacgtcgtcaacaagccgaacgtcgctatccaagacactacgccgtggttcgccaatctggagttgtctgacgctcggcctttcatcgatttccacttcaacaacaaccgcgccaaagacttcgactatcgctttatctctgaagctgatggatcgatggcgttctactctcgccaggggtcagctggtcctacccaggacatcctgttcagcaggtcgaatgttacattcctccagccgcgactggatgttgcgaaaaacctcgcgtacatcgcgaactctggttccctttggcagaacacaactgccgatcagcctggttggaaattcaccttcgcacaaggtgtggacgccaacaacaatgcggttatcgcagtcaataccaccaatccggacggctcctatcgctcacagatcatgcgatgggactgggcgtccacgaacgtcatattcaacaaccgtccgctcttcgccggtcaatacaccccttgggattctgggaacttcgatccttccaccaagttgacggtgaatgccacgaaccaaatcgccggcccaaccgggattcggaataccaacggcaacaccggcaacatgaacacctggggttccggctccacgacggcatcctatggcaatgctgccattcaaatcttcggaaaagggggcggtgagcctgccgcgatctatttcgacaactcccagaccggatggtatctgggcatggacaaggatggacagctcaagcgggccggctggtcgctcggcaataactcctatgtgatcaccgacgaatccaacatccgaacccatatcaacacaatggctgcgcgcccgatttgggggaatgtcgagttctggggtccgtggaacttcaatccgaacactaagcttacgttggacgcattcaacgatagccaatacaccaggatggtaaacagcgccgcgaaggacgtagggatagccgccatgacaagttatggcgacgcggctatgtcgttcttcaactatgaggcttcgacgccgaccgggaatcgtgctgctgtaatttcgtttgttcgtaacggggcacgaggcgttctgttcggcctggacacggacaacaagctgaaatggggcggctattctctaggtgccgtcgcgttcgagattgccgactccaacaacctcatgagcctgtggtcatcccacgctgccgcgccgaactggaacgggcagaccatctggaggtcgggaaacttcaacccagacaccaaggcgactttggcagctcgcaatacgacgtcatcccctacaatattcagttatggggcgtccggaatcgcatcaaccggacaggtcggtgcgttggttgtggaaaacaacagcgtcaccaataccgcagccgccatcacgttccattcgccgcagaaatatcaggtcaacttcggcctggatgcggacaacgtggtaaagatcggtggcggcacaatgggcggcgtagcatatcccatcatccactccggcaactacaacaactacatcaaccaggcgctggttcaggtaggtcttggcggcgtcggttcctacgcgatccttgccgtattggacacatccgcgccggcagcgtccattgcccccggaacgatcatggacagttccaagctgttctattcgtcctgcgattcgacctatcgcagcagcgcccgtccgacgggcacctggcgctgcatggggtatgtgtataaccgagactccaccaacggcgactcggcatccctattccagcgggtaacgtaacatgaaatggacgcggatcagaaacccacgttggctggacgcggtaaacatccacgccatggttactttcgaggggattggagaagttcctttcaccgccaatccgcacgacgtggaggcccacggaagggccattcacgctgcgatcctgtccggggcgcacggccctatcgccccagtagactcgacgcgggagcaggccttgcaggacgctatacgagacagggaaaagcgggctatccttcgcgatacccgatggcccatagatcgtcacgacgagcagaggcggctgggtatcgaaaccacggacgggcctgggctgatagcagcccttgttcactggaggcagcagattcgcgattggaatagcggggatcggccgcgacttcccatggctctgaaaacaatgttcaaaaatcaggagtattgatgaaaatcacgaaggatgttctgatcaccggaaccgggtgcaccacggatcgggcgatcaagtggctggatgatgtacaggcggccatggacaagttccacatcgagtcaccgcgagccatcgcggcctacctcgccaacatcggcgtcgagtccggcggactggtaagtctggtggagaatctcaactacagcgcccaagggttggccaacacctggccgcgccggtacgcagtagacccgcgagtccgcccgtatgtcccgaatgctctggcgaaccgcctggcccgtaacccggttgccatcgccaacaacgtgtacgcggatcgtatgggtaatggctgtgagcaggatggtgacggttggaagtatcgcgggcgcggcctgatccagctgaccgggaagtcgaactattcactgttcgccgaagactccggcatggacgttctggagaagccggagcttctggaaactccggccggcgcgtcgatgtcttctgcctggttcttctggcgcaatcgctgcatccccatggcggagtccaacaacttctccatggtcgttaaaaccatcaatggcgccgcgccgaacgatgcgaaccacggccagctccggatcaaccgctatatgaagaccatcgccgcgatcaatcaaggctcctgatattccacccaaagaaaaggccgcttattcagcggcctttttgctttctggctttgcctcttcaaccatcttgacttcaaccggcgcggcggactcttcctgagtgaccgaatccacatagttccctagtgaactcagaacgccgattaacagcgctcttaccaccttgtccttgactgtctcgcctatgatcttggtcagaacggatattaactcttcccggagtctggggctgattcttggccgaaagcgcttgcgatgctctttgcgtttcatgtttagtcctctgtctgcggtcttctcctcaccccgataatggcttggggatgcgctgtgttaatcggaaggttcgggcgctattataactcgtcgaaaatgctcgcgcttaactgtttaacgatacgcaccgcgatattaaatcgccttctttctggccaaggaactctggcggcctggtccggtctaaggcctaatttgtcgacattaaaacgagaaaacccggatcgcctgtaggacaaggcgtccgggtttatctcgatctagtgtacgctagaatcagtggcttccgccccatccgtccagccagcaatcgaagacggcgtgtcgcggcttgtccttggcgccatgagagaaatgcttgaatcggatgacctggcccttgatggactcccggtcgttccagaaacgacgtttctcgtcgtgggtcaggctggatgccgacacgttgaaagtgactccaggccacagacgttcgttgcggcagactaacgcaccgaccattccggacggcgacaggttttctgcgtggctggagcgggccgtgtggccaagttcattgatgaaagcttcattgttgttgtgcatcaactcttccacgtcgatgatctcagcttcatcgtagtcgtatcgcttgactttcacacagtgcccttccttggcagtcgagcgaccgaacttgtacagcccatcagcgcgcttgcccatggaaccttcgaatcccagcattgtgtggcggcgctcgacttcgctgaactgttcgatggaagtcaccagttcctgctcgaccaggtgaatcctctcatagccgaggcagtgacgaaggaagttcacgcgctcggccgccctggctaggcgatcttcggtcggtgcgcgaggatcggtgaaatcatcgaacacatggaaagaccagtccggctcaccgctgtggcggcgaagatcgccggacgacttctggaaaactttcgggtcgctgatgtcgccgcagaccagctcgccgtccaggccgttgaacaatttatcgctgaggtattcgtagatcgattgattgttctgccgcttgagttgacgagtcagcgcctcgccttcgaatacgaagcagcgaaatccatcgatcttcggcgagaaatacatcggcagttggccttccagcagcttcgggtcaaaattcgatgcgagcatgggtttcatacagttctccagaaaagaagcccggcgaaccgggctaaatggcggtaagccggctcagatggtttcgttggcatagttcagttcggccatgatcgacgcatagcgctcgtccgactccttgatgaaaacgccgtcgtacatgacgcctttgcgatccttgatggtgtcgtaggctgcagcgtagcagtcgagcatggtggtgtcgtgctcttccgtcaagtcgaacagagtcatggcggccgataccaggctcttgatggccaacccatgatttccacgtgccagagcgcctgccagatcgccgaggcgctgcaaatcgtcgccgtaggtgggatgtacttcgccgctctcgatgaaggccgacagatgatcgaacagattttcgccgagttgcgcggccatgatcgtggcaaccaccattacgtcgccgatgccatctttcacatcgaccgggttgttctgaacccaggcttcgcatacttctgcgaactcttcgaccaacttcaggaattgatctttcgcagacgagcctttgatcaggttacggtcggaagcccatttaacaaccaggtcgtgaagttcgcgactcatgatttgttcgatattcattctttcgattccttttggatttgggattttactgcgttgattatggacgccgtgctctggcgcgatccgtccttggtggtgccgaagtagaaggccattaccgacttcagctcggcgaaccaatagccgatgatggtgccgatggcgacagaggatgtcgggtccatcagagcctcgcggccgaatgtgaagattgcgatgatgatgagaatggagcctgtcagaagagcgaatgtaatcgccgggcgaacgaaatcgttctgctgcgccgcaagcctcctcgcagaatccctgtcggccgcctctgcggcgaactggctaagatcggcctggagctggttctgctcagactgaaggcgattttgttcggcttgaatcgcaagctcctggagacgaacgcgctcggcgctctggagttcggcgagacgcgctagagcttccggattcgcgtctagagcgctagcgaccgaggctgggtcggccttcgaccccagcgccgtcgcgacgatagcgcccacggcggcgcctgcaggcccacccaggagcgaacccagagccggggcagccgcgccgatcttactacctatgtctttccagtccatttcgactcctcaaaagaaaggcgccattacagcgcctttctccggccggtgatttagaactcttcggcttcggtcgcatcgccgacgccaccggcgtcactgcgaggctgttcctgcttgctgtagtccaccttcacctcgccgccgacgaacgacttgtacaggtcggccgcagccttgaagtgatccgggttcttcaccaggccttccagctcgaactggacgccggaccagctgcccttgtcgttcgacatgcctacggtggtcatacggaccaggttggcgaaagtcggcggggtgcgcaggccctgcggggtctgaacctttttctgggacagcgcggtcatgagcttcttcgaggccttgatctgcgaagacgacagggagatcagagcctggccgaaatcgccggtgtccggatcgatgacgatgacgtaatgaccacgggtgtcggcgaagtagtcagacttcttgtcgctgaccgaaccgtcttcgttcggcgcgtacaggcgtccttcgacttccttcaccttggtcgggtctttcatcatttccttgaagtcttcgacgctgatggcacccttgaaaccgccctcggcctcgcgaccggcccagcggatgaactcgcggcggtacgcggccggaatgatcagcaggccggtcttgccgtcgtaaatcttgccggtgacggtgttcaggaacatgccggccttcgcgccttcgatgtacttcgggtcatcttcatcgacctggggagacatcttctgcaaaacctggatgaaggggatggcataggactcggcatcggcgccttcgaagcctgcgccgtcatacgatcccaaatccatgaagtcgggaacttcggtagttgcgacggcgccgccaccggtggcaactgctacggccttggtttcttcggttgcttcggaagtttcggttttcttaccagccatgttaggctccttgtttgtcgaatttcagttatcgctaactgtgggtttataataacggaagttgcaactaagtaaagcaaattacatatcaagatttgctctttttcaccttcggtttcgtgatcttggcctctttgtattcgtgtacgccgatgaaatctggcagctcttcgcccttctccaggtactcgcgaccgaacgcctggagggtctggtaatggacatcgcggttgatggtggcgtcatagccggcttcgatgatggcctcggccgccttcttcgcatcttccatttcgccgcgaccgaattcggccagaaccttggtcttgatgatgccgtcgttgtcggtgtcttccagccacttccagaacttcgatttgttctcttccttgacggaaatgatggccttcggctctacttttaccgtgcgaccgtccgccagagtagtggtcttctgaccaagctcctccaacagctccggaatggtgttacgcttgagggtcttcagctcctcttccttttcggccagcgccttttgaagatcgaggatttcgccgtccagctgcgaagccttgtccaccaagttcagcagtcgatggccgatgtcggtggcttcaaccgccatttcatccatgacgccaaaatagtcgatttcgcccggcgcgttctctttcaagtattccgggatttcaagctcttgctctttcatgtccgcctccaacttagtgatgttcccttacttgaactaagtattgagtagatattatgccgcatcttccttgatacggctactgatttacatattaaatttcgtcgcgagtgctaacgtcagcctcaaacacgccatcaacgacataacttgccaggttgcgcttccactccaagctgacctggattttctcgtcgatggaatccaggcagatcaggtcgaagtacaaaaccgagttgacggtgccgattcggtgatttcggtcttcggactgcatccgcaactcgttgtcttcgtcggtcgtgtagtaaatggccacgtctgcggcggtgagcgtgatcccgatccctgctgcggccgggttgcccaggaacacctggacgcgcttggcctggaaatcgtcgatcaatttttcccgctcggcctctttggtctcgccgtagtatgtgccaaacgaaattccttgggcctccagatacgccttgatctggtcgatttcctgaatgcgcatggcccagatgatgatggagcgctccgggtcttcctccagcagaccctccagaagatcagtaaacacggcgaatcgcgggttgtcttcgggcggcaggatcaccggttccccatagacgttgatatagccggacgccacttgcttgagcttcgagcgcgctgccgcagcatcgaaagatacatccagcatgaaatcttcgttctggagaacgaagtggtagtcttcctcaacgcgctggtaaacctttcgttgctccggcgacatctcgaagtatatgcgcttgtacaccttgtccggcaggaatgggagcgcttccttcttcgtgacccggaaactgtgcggctcgatcagggaccgaagcttgtccaggttccggaataccgggcgcccacactcgtctttttcgaccagttgcggcggcatggtctgcttcccttccagcttgcgcatgatagctatcattcgaggatcgtcactgggcaccaagacggaaaattcggccacaaacgcccgataggatttcgtccccagaattccattgcgcaagaattggaattgcatgaacaaatcggtcggtgcccgcgtcagaggagttccggaaaggatgcgacgggccacggccttctcgcccagctttacgatctttttcgcacgcttggcttgtgggtttttgatcctcgttgactcgtccacaattgcgcaaactttgaatgtatcaaggaatcgctcgacctcatcatagccagcctggtggttgattgcgtcaacgtttatggcgaagacgcgaagaactttttcatctgcgaacgtctcggcatacagacgatccaagcgcgctctggcctttttggaagtcggtcggccgcgccaatccacgctcaaagtcttgatcgcgacgtgggtgggaatctcgcgcagaatccagttggtgtggacgcctttgggggcgacgatgagcagcgcgtccacgcgcccctgtaggaagaggcgaacggcatcggccaaagtcgtccaagtcttcccggtgccctgctccatcaggtatgcgaaattccgtttgttcagggacgcggccagggcattgaactggtgctgcatggcctcggtcttcatgcccttgacgggatatgttttggctttcatttgttctccaaatcggcgaggaactgaacaatgttatccagtccttctgcatagctcgcaacttccaccaagtcgcggctgttaagctcgaacaaatcgagcatgggattcagcagcagccaatcggtcccgatcttggccaggacgaagccacggccgccccagccgatccgttcccgaaggaaagggatttgcccaggctcgaaacatctggccattgggcaggtggaggcgcgtttcggccactcctccaacgccttgaactcgacccagaactggacgcctcgacgattcaggcaaatcgaatcggacataccagaccgccgcgtctccagaaagtcgatcaggattcggccgagtgagcgttgcttaaacgcattcgccgctttcgtttcgcgatcattcatcgccttcgccctctttggaaactttctctgcttgcgctgccagctttgctttttcgcgttcggtcaaaatcctcttgacggccttcacgatgaacatatcgattccgctgagcttccagcctttgatgaggaaccaagagcctgtcggcgttccttcagcaatctgctttccgtattgcagatatttttcaggcctaattctgaaacgtatcggctgatcaaccgagtcgtcaacacacatgatgtcgagaaactgcgactggcccttgtacaccgggtttttcccttgatctgccctcttcttctggcgaatcggttcgttctcatcagacagaacttttttcaccatcttgacaatgaccaggccatcgtctccatcgcggatatcccgcatgttctggatggggtttccggaagttactccaaccagctccggattgtcataagcatgaccccagagcgtgtgagcttcgttcaaatctgcgaattgaacttcagaattcgacagactcgcggcgactttctcccaatcctgaagcgtcttcaggtgggttccggccagctctttatattgagctttcagctccctaagatcggcctttaactccttcagatcggccttcaacagtttttccagttctttgtcttggctgattttcgccgaaagaatctgggcttccagcgctgctacatcagcagccttgtcctcaacatcctgtgccgatatcgggcaattggccagggcgatcctcgcggccttgacgtcatcacgaaggcgcaggaacttctctgccttcgccgggccgaagcctttggcgttcatgatgccgccgatcaggcgtccgtccgccactacccagttaagttcggaatgctccgggtccagggccgtatattctacgccttccttggccaattcgcgaaggatggatacagtttgctggtcgtctttcgccgcccgaagacacgcggccgcgtattccaggcgatgataccgcttcatgtagcaggtccagtacgtcaccacagcgtagctgaccgagtgggagcggttgaatccccaggctccgaaagtcaccatttcctgccacacacggtgagcatcgtccggggcgacgcctatggtcttggcgccctcgatgaacaattcccggcgcttgttgaagaactcttcgccctttcgcgcagacatggccttccggattgccgatgtctgctcccagtcgaactgtccgatgtccttgacgatggacatgatctgttcctgatataggaagacgccgtacgtccctgacagatattgctcgacctgcggaatggtataggtcacaggctcgcgaccggccacgcgctcgatatacttggttgccataccagaagacaacggacccggacgggcgagcgccgtgatatggtcgatgttttcgaacgcggtgatattgatcgcgtttgcgaccgaacgaactgcctgcccttcgaactggaaaatgccggacattttgtcttcgttgagaacatccaggaccgccttgtcgttcaaaggcaagtcgtacaactcctgcgcagtcatacagttcgcgtcctggatgacgcccagagttcgaaggccgagcgcatcgatcttgaggagattcaaatattccgaatccggcttatcgagctgcgcgacgccttcagaagttaccgtacagaagtcgataacttcatcgttgcagaccaggatgcctgccgcgtggactccagagtgggatgggtgaatttcgaggtcgcccatgcaggcggacgcgatctcatacttttcacggaagtcgcggccgggctgagttttctcgaaagtgtcctccaatccttttccatatcgttcgtccgccgacgtatattcaatgatcgagtttttgatgttgtcggtatcgtggaaggggatgccgaagcgctttccgacgtgagcgataaccgacgcggccttgagcgtattgatgttgcccaacttcaccacgttccaagtgccatacttctgctggagatattcgaacactagatagcgatgggtatcggcgaagtcgatatctatatcgggaagatcggaccgggaaatgtcgataaagcgctggaagagaaggcgatgagggagcgggtcaacctcggtaatgccaaggagatagcagaccaaagagccggcagaagagccgcgagctggaccgaccagcatgtgcttcttggcaaacgcgaccaaatctgccacgaccaggaagtagctgtcgaaatctttcagctgaatctgcttgatctcttcttggaatcgatcctcatactcctgggtccattccttgatgtggccgcgactgaggcggtaggcttgcccctcgcgagccagagcgacgatatcaccatccagatggatcatcggcgccttcgccagtttcacatccgccaactgctcgactaccgcacgagtattggcgatggcggaatcgaactcttcgcgagtcatgatgtggcgtaaacggctccacagctcctcttcggtggcgatgtggcgaaggccgaccgattcccgcaccttccaggccgacgcgaaatcagcatggtcgatggacggcatgtcgttgtaagaggtaattaccaccggctttccgaatgccctggccgtctccatagcgccgtgcgcggcgaccatcgacgcgggattgatgtcaatgtagtcgattccggccagatccagatgggcataggcctcgccagcgaatttgatgacgccgtcagcttcctggaattcttgcggagtcaatccttgattctggaccgacttggaagtcaagcggtagaacttcttggtgtccttggcgagcacccaggctttgagcttcagctctttctcgccatcgtcggcgcatttgatcggtatttccatgccgaatccgcgaggcagttctgctttgatagcggcctgctcccaacggacgtgaccccatgttccatcatcgacgatggcgacgaatggggattcgatctctttggcgcgctcgatgatctccgggaatcggccatatgcggcgccgtaggagtagccagagcgaacgcgaagctgagggaaagacattatgcggcctccattgcttgatatgcccgatatactcccatgcgcttacagacttcgtggagcagccgcacgtcgtccagtgcccggtgtttctgtacatatgggccgcagtagtgctcataaagatgttgcaaccgcatgcggtggccgaacaacggcgccgactcttccacagtacagatatcgagtgatgggaaattgacttcgtccaggccgaacttgccgcgagccagatcgcaggtcagcatgaacttatcgaatggtaggttgtgggcaatattcgcgtcggctctggaaaagaagtcgcgaactttctggcgcttatcgaggaaagatgggtgcttgatcaggtcttcgttcttcaacccggtgatcttggtgatgatttcctcgatgacgattccaggattgcagatgaactctacttcatccaaaatcttttcgccatcagttatcacgcctgcgaattcgatgattctcggctgctttctcagactcaccctctggtggaacgggagtcctgtggtctcagtatcccatacagcgaatatcatgtttgttccctcttatgtcgaaaggccggctgctttcgcgaccggcctgaggagtataccgcgacggctgaagatttacgccttctgtccgtctttcggcgtgatacggccggagcgcatggtggcttggatgaacgccgaatagttgatcgagtccaaggccgaatcggcatccttgaatccgctattcgccaggcgagtgagtttgcccaccatatgcatcacgaacagggcgagccgatggtcatctgcggtcttcgccaccaggccattcgggaagaggatttccatgatctttccgtacatcaggtcattgcgaccataggtgctctggcgggcgcggaagacttctgctgctgcgtacagattgttgaggacatcttccgcgaaatcatcgggatgagcgtcatcttcgccaggccagacggattccatggcgaacggcgcggcggcatcttcggtcgggtcttcggactgagccgtttcagcgagcggagacggggctttcgcaaacgcctcgtcgagggtaggggcggagttcggggcggccgggaacggctcgcctgccatgtcgttgggcgcgctatcggggtcgctatcggccgcgacggcgaagaacggcgcatcgcaaccttccaggttcaggatgtaggagtcgatccccaggctattgtaggcatcgatgatgtcctggcgatcatcgaacgccgcgacgatcttggtgacgccttcgattttcttcaggatgtcgagcgcgactgcccgcttgaactgaggcgccggctcggtgttaccatacggccgcatgatgagttcatactcgcgatgttcggcgatgccgagttcgcggtggagcttggccctggtctggaaaaagtggttgtcggttcggccggtgacgaagaaaatcatgaggtcggcgtcgatggcattcctgatgcgacctacagcgtgcgggttgagagtgtccttgtcgagacgagaatgatactcgtcccattgccgttccaaggcgaagctcttgcggtggctatcgtcgaatacgcagccgtccaggtcgaagatgatgatgccattctttggtttgcgttccatattcagatttccttactggttgctttctgggtgacggttttatcgatgaatgtcccatcagaagtgaggcggaaaacttcgccattctggatgaaatcgaacgattgcacgttcatcgtgatgcgaatggattcgctgccgttggtcacttcgacttgtgcgatgtcgccaactttctcgacaatgatcttcatgttacatggacttcccattgacggccacagggttggcctcttgtttttccgatccccagaaatcgcggcgcagttcttcctgctcggccgagcgatccatccaggggcgatagaacttgcactggtagataggttccaacggaacatcaatcacaggaatctgacctggctttgtctccagagcggccatgaaccggtcataggatttctgctggatttcctcttcattcatcaccttcgacccatagcgcgggaaggcgcaggagccggtggcgacgcagtgcggctggagcaggctgtcgaacataggatagacttccagaaccagccggcgcatttcgcggaatacttcctgatattcaccctgggtccgaacgcacaggcgaaccttcgccatgtcgctgagagtccgcagattgaacttggccgcgatcttcgtttccatgttggaagggatgatggcacgagcgtcctggagcgacgcgccggcctccagaagcttctggtagctggtttgcgcgtcggcaatggcgtcgtgccacaggcggttcagctcttcgcggacatggtaggtcgggtcaggctcgccatttaccgtagccggttcgtcgaattcccagcggaaggattccggctgaacgacggcgctgatttccagagcgcgactggtttcctgctggtaagccccggtacgagtccgaacgagttgatgggtgaagttcttgctgacaccctcgatctggaaaatgaagtccacgaactcgaacggcgagcggatggtgtccagcatgtacttccagtggtcgagcttttcggcctcggtcatggtcgccgggtcttggccgcgcatgcgggtggacttcgttcccaagagcaattcccaggcgttctgggtgtaactaatcagagaaatcttcatcagaaatcttccggaattggcgtgaagtggaatttttcggtgagagccagggccaggccttgggcttgctccctgttaaggccatactgctctatctcttccttgagcagttcgcaggcctccagacgcgcctcatactcttcagcctcatggacggatgagaagacggctccatcagaggttcggtacacaagttcaatcgacatgatgacctcagtagcagcggatgatttcggcgcggatatctcgacggtcgaggtagtgctcacgaatcttatcgcgggcgcgctcggcctcttctcgactgccgaacgacaggttgaacgaagtgaaaggcttatcgtccaggcgcccatcgccaatcaggtacaggacgcctaccagcacgaaagacggcgctgtctgtcgcgtttgcggcgggtcgatttgcatttcgaggaaagacatgggaacctcttcaggatgatctggtgcgtacattaatagcgctcctgctgagcagctacggtttccggctcatagatgagcatgtcaacgatttccgggcactggcctttcacccagtcgatggccgcgaccagtgcggtggaagcggagaaagagaaagtgcggtaagactcatggatgtacggcgaccccatggaatcgcgctcggtggtgcgcgaaatgactgctttgatattaacgatccggcccatcttcggcctccactttagcgattatatcggacaggcttaacttctcgccattcaggaaataactggcgcgaaacttcctgtcgccctctggcccgacgattcgggccgttattgtgagactcccgccgccaagggcatcggtgtccctgaagaaagctagcagcgcccgcttgagcgctgcttcgcgaggatcgacggccattaacctaccacgttccagccgtgctgagcgcaccacacggcaccggtccctgcaggaagactattcagaaggaacacaggagtcaggcggccatcctcggtcatatggacgaagtagcgggcgccttcaccgagccaatcggccttggcgatggcgcgttcgagattggccttggtggcgtaggtcttggtgtggttcttgtcggtggagaaggttacttcgcgggccatttgtcgattccttttggttgaagggtttcgcgtttcgatgagggaatattacgcccacctgatccagaagtaaagcacttttgtaaattacttcacgaacattttcttggccttctgataagacgaagaagtcatcaggcgctcgatgacgtccatgtcagaaaccagatcgtccagaaggacgttgcgccaggtagcgaaccggccgagcgagaagatgccggcttcatgggtgagattccagatcatgaattcgcgctcgtcgcggccgagcggaacgattttgcctttggtctggatggtcggctcgccgtcctcgatgagatgccttttccttatgccgaaggccgcgcaaacgtaatccatatcccagtcgctgtcccattcgatggtttcgattttaccatctaaagtctccactatccccttagtgatggattcgacgatcagagtatcaccggtgatggacgctcgaaacgttcccactttaggaccagggaaatacacggtctggaagacatcacaggggatggaaagcttgtatcgactcacgatgatggaggttccttcaccgaatgacgggtcgattcccaggtccagccctgccgcagccagattggcgcggaacggcgcggtgctgatgatattcacgtggtcatcttgccggcgaagatactggaagaaagaggcgtcgaaaggacggctccaagtgatacgattcgcaagcttagccaccagctgctcatagtagtcggccggtgcgatccaacgcttttcagtcgccagattccagatggaccggtccgacaggccgccagttactttcctggagtacatgttgcagtggtcgatgcgcggctgggaaatgaactcgccgtcgatgtagatagctttgtgcacagtgacttcgcggaacgggatgccggtgagttggccaatcactggcgagcggaatcgcagaagtgcgttgtggcgctccttattctccggcgtcgccgcgtcgatgatttgggcttgaggaaagcgatgcgcggcgatcagtccggcgagtccggcacctacgatgattactttctgatcaggaatcatgatgtgtcccttatgagtgtacaaaacttgagaggataaaaaagggacccattttcatgagtcccttgaagagctagacgattcggtctcagaagagcggcggcttactcttcttcaccatcggaaccgtcggcgccctgaccttcaccgtcgtgctcctggccttcatcggccttctcgtcatcgccctggccagcttcgtcttccttcgaagcgatggcaaccagatcgacccagcccatgatttccagcttgctcaggtagctgcgaaccgaggtgccgtacagcaggtgggccaccttctcgccgaaggattcgatttcgaccggctcaccaacggtgcagtgctcgttgatgtaagcaaacaccttgccgcgagtcgagaaggcctgcggggttccatggccgtcgccggtcgggatgaagtgagtggcgcgggggcgacgcgagccgttggacttcaggtcttcgcggcgggcttcggccttcgcgcggcgctcttcctgctcttccttgcggcgctgcttctcggcttcgcgctctgccttcttctgctcggccaggcgcttgcgctcttcttcgcgtgcggctttctgggcttcctgcgcggccttcttctcttcggccttcttggcgcgctcggcttccttctcggccttcttctgctcgcgctcggcttccttggccttcgccttctcggcctgctcggcttccttcgccttggccttttcagcacgctcggcttccttggcggcggccttttccttcgccttctcggcgcgctcggcttccttcttctcacgctcggccttgcgcttctcttcgcgctcggctttcttctgttcggcttccttggccttggcctcggccttctcggcgcgctcgcgctctttacgttgacgctcagcggccttctcggccttgcgcagggcagcggcttgttccttggtcagctcttcgccttgggtctgttcgttctggtccttctgttccatgttcttactccgggaatgtttaaagggatggcttattggcctgtgaggggattatctctaaactaattgaagaagggaatacccttagcctgaactttcctaaatattttctttcgggaaagtccaaactctagggaacttatttatgttcgagaagttcctagcttttacgcaagaacagtaagtattcgattgcgcgagttatcccagtatacatcaactgactataagggatggacggcaagttttcttctaacatggcaacccgtttccattctgaaccctgcgacttgtggaatgtcatcgcccagccgaagtcgaatccgccaatagccttctgcgcctccagccgcacgtcttcctcggccgaaaagctcaaaggattgaacttcacccagcgctcatagttcgtgccgataatgcgaactttggcgaacaacatttcgtccggctcgtcatcatcctcttggccttcggggaccggcttgagttcgagcaggatggcttgctcgccgttcataatgccgtattcatgctggttcccagtgcacaccagcttctcgccgatttccggttgtaaacccttgtagccgaggatgcggcgcgccctggcgttcaagcggcggcgagtattgttgtaggcgcaaaggatcacgccatcgtcatccaggaacgtccgcatttcgtcgtccgacatatcgaagccagcccggactaggatatcatcatactcgcggcagggcaggcgtttgccctggcggacgaacatcgacgctcgaacgatattcccggcgttacgctcgatttcagtcatgactgtgtcgcagctatgttcgtggaaaacctgaacgccgcgcacagggggaacttggccaaagtcgccgatctccagaaccggaattcgatgcgccaacaagcgctcttcatcccactcaccggtcattgacgcctcgtcgagcacgaccaacttcggcttctcgtcgagcgagtctttattggcgaacatgatttcgccgtcttcatcctcgccaatcggccgatagatgaagctgtggagggtccgggcattggtgcaacccttctcgcgaagccgcgctgctgctttcccggttggcgcgacgaagaccgtccagtccatcgagcagcaaagttcggcgatgatcttcgcgatggaggtcttaccagttccggcgaaaccagcgagtcgatagacctggcggcggtgcgctcgatcacaccaaccgcgataccagtccacaacggaattgatcgcgtcgatctgctgactgtttggtcgaaagccgaatcgctcttcgatctgatcgacggtgaagttagatgctgacatatttgcgttctccaacgctaggtttaattgaatcgaggctcagtttaagcacgccgtccacagaccagccagtatcacgacgatacttgcggccttgcggatcgacatagaagttcttcgtgcgccgcagcagaacataatgccaagcagctccaagcgcgtggacccttcctttatacgggaaagccttcgcctgctctgcggcctctttggccccagggagccagcggacggtagaaaggaccaggaccgcacccttaatagcctgggaagcggcgcggccgtcctgtgggctatagcgatgtctatcgaagtctacccagtggtggttgccgcgccggagcttgaccgttcgggatcgcccctcgaacaccactgtgccttcgtgagtaagaatatgttccgccatcgaatgttcctttataacgtacagttatgctttacctctgcgcaggaagagtatactatcagctgactcgccaaagcgagcgaatttaatccaactttacttcggcaggaaagtggccgatactagcgccgccgcctgtactgccctccaaaacagaggatacattaaatgcaagaatgcaagatttcccgcgaccaactcccggtcggtaatccgaatcccaatgtcgacaagacccgcgacccgaacctaaaacccggtttcctgcgccggagccgcgagctggacccggcgctgtccgttcgcattcgtcgcgagctgatccacgccgaagcgtccgacttggccatggccggatgggtcaattcacagtccagcctctatggatcgaaagccttcccgcgccattcagtcgttcgcgtgaccggagttccggaagatggagctttcataggcatgctgatcggcttcatcgagcatcgcgagcacggcgaatgggcggtcatggaatccggaacgaaagaaggcggcgccgtcatcattccagtcgatcacatcatgcgagcgtcattcgccgaagcggaagagttcgctgaaaagtgggagcggaacttggggtggcgtctcctgcgccaactccgcgagtgcggcgccctggccgggactgaagacgagttcctgcggcggatcatcaatcgatatgttcgtgatcgcacgatcctcgatcaccacaaagtcggcgcggacaaaatctacactgatgcagtgctcaaaagcatcggtgaaacatggccgaaaattccttcggggaaattcgtcggacaccgagtcgcgcagctcctgatcggccacaagctaggtcgagcggggaccatcctgaatgacctggtggacttcctggagaagttcgcggccgggcgcgataaagttctcaacatcgccatctgtaattgaggtgaatgatatggaagatttgggaaagcccagtattccggagttcgagaagatcgacgccaaaaaactttatgaggctctggagacgattgcggagctggagaagaagtgggacgaatccgaaaagcgcacacgcgatctggcagaagtggaacggccagaggtagtcggctatcgcagcgcggcttctcgcatggtctatgaaaaggactatggactgcagaatcctgagccgatgatgcttgtctcccagcacgaccgcatagtcggggagctgctgactgcattaacctcgatgactgaggcgcgcaatcgctacaacaacctatggaattgcgctggtaaccgcctagctttggcgcaagttgaaatccgcaaagtaacatccgagcgctacgcagccctggccaggatcgctgagctggaaaaggaattggccgaatccgaaaagcgcgggagcgaactggccgcgagctattgcgatggcgtgatcggcgatgaacacggtcatccttattgtcgttataaagtggaacgcgacgccgccttggccgaagtcgagcgcctgcgagaatcaaaaggcgatccctctggcagcttcgaccgttgtatgaagatgatgtacgagcgcgacgagaatgcaaaacgactcgacgccgccttggccagggtcgcggagctggaagggaagttgacggactgggtgcgcgaagggttccggctcaatgaagcgctggcggtcgccaagtctcggtacggtgcgccggagggttatgccttggtcccggttcgcgagacggaagcgatgcacgatgctgtaatggcgctgctgtacaatggcgtggcccgcaccgatacacaaaagctactggatgcgtacatcaacgctgcgactaacaaggagtccgtgtaatggaaccgaagaaaccttcaccagtagatggagtcatcatgaccagcctcgacgttctcaggaaggcaaagcctgaagctcaggacgagtatgccctgtccatgttcgcaacggcgatccgccagaaactgcagcgctcccgcgataaaggccgaggcggctggatcgactgcgacgaagatgttctgatcaacggattcgccgaacatgcgctgaagggtaatgagaacaacctcctggacctggcgacgttcctgatgttcatgtgggtgcgcggcatcgatgatgcgaagattcccccggcgctcgaaaaggcgagacagcacaagatcatggaagcctggagtcgaatccatgaagacggcctgaactccgccagaaaggcgagtgctgcgcgacagttcgtggaagtgccacgacgcaaggggcgcccggagcgacttgcatgaagcctcacgaaataagactggcccaggccgaagagttcctgcgcgaactcggccgagggattccggacgacgaacgggtgatggtcggctacgctgaagaggccacagtccagaccgacgagaacggccgcaagctcaacgccggctggtggcctgtgccctggaaggaagggaaatacatcaactccagatccaacgcctacgcttgcatctcgtcatccatcaagacgcccaacccgaagaccggccagatgcgatactggcgcggcgaggcctctttcggccacggcctggcgttaatggtcgatgacatcggctccggcaaagggtccaagggcgacttcgaccgcgacgagttccgagaacgactggagccgaccgcgatagtggagacttcgccgaacaactaccagttctggtatttcttcaaagagccgatgtcccacatgctccagttcaaggcgctgctctattcgtttgtggaccaggtgctaaagaaaggcggcgacaacaccgtcaaggacgtcagccgttacggccggatgccattcggcttcaacaacaagcgcgggaaagacggcaagttcaaatatgccgacgaaaacggcaagcccgaactcgtgcgtctgtatcacgcagactattccaagcgctactcgccagaggaaatcgcccaggccttcggcgtccgtatcattatgccacagatgaagaaggtggagataaatcgcgacgattgggtttatgaccaagtatggctgaagtatgccgagcatatctgtacgaagtacaagatgggtgaggcagcgggcggccaagtccaacagaatatgtccggcaaatatcgcatccgctgcccatggggagacgagcatacaaatggcgatccattcggcgcctactttcgcggaccgatccctggagccgagcacgaatatgtgttcggctgcggccacgatacttgccgcaaagagcatcgacggacgtgggcggccttcactgatgaagtagtccttccctatatcgtagaacaattggaaagaatcaaccgccgtcatatcggtgaggagtagacaatatgcaaaacgatcctggaatcctgattaccgccatcggcttgctgttcctcggccttatcatcttcttcgaaggactaaagggatggaaaatacaagtcgcaaacttcctcgcgtcgcttctgtgcttcttcttcggcctttctgctttgacgttctggttcgtcgttgcgtttgacgtattttaatcgacgaacggtacagaaattttcggatggggacggaacttattagctatgccggtttaggtaggagataatagccgtccctttcgcctcaatgtgtagaggcaatgttgaatccgatcatgtaaagcagaaggcggcaaacctaacatgattatcgacgaagataatatttttgatgatggcgaatcagggtccagtgagtttgatctcacgcagatagaagatgctggaatggaccctttgatgaccgccgcgagcaaggcggccgatgatgcgattgcgaggaatgagacgtaccgagcacaaaaggcggcaaagtatgccgaggcgtatgcggaaccagatctgaagaagcgagcgcgattgttgatgctcgatcaggcctttgatcttcctgtcagccggctggtgaaaggaccgttcgacgacttcatcaccaagtacagctcgacttcagacagcaactacctcgcggtctatgatacgttgttctgtaagggcgacggaactgtcccacacccgcacttcgacgagtttcgcggccggctggtggaccaccgaggcgtggcgttcaacaacaagaccctcgaccccattgacctgatgggcgccctcgctgctgcggccttggacgatccatcgatcaagaagacgattgagacttgctgcgtgtgggcgcgtcgatatcgccgcaactctttgatcgagacgtttgagaagaagataccggagtgggatggcgaagagcggatcgaaacgctgctgatcgatctgtttaagccgttcgacaccgaattgaaccggatggtgagcaagtatttctggctgagcctgtactgtcgcatcaattatccgggaatttcggcgccgatctcgttggcgttgattggtgggcaggatgcggggaagtcatatttcggcttgctgatctgtaaggaactgtccggtgggcgcgatctggctccagtccaactcgacctgagccggcatgatcagacgccattccttcgcaacatcaccggcaactcggttattgcgaacgtcggtgaaatgtccggcttcaaaaagggcgacatggaacgcatcaaggaattcctggtgcgatcttcggatacattcgaccagaagtttgagccgggcgaaacgatcaagcgacaatggatcaccatcatggacggcaacggctacgatggactccagcgggacgactccggcaaccgacgcttctatccgatgttcgttgcgcaactgcccgatgaagatggaaaaccgaactgggtcaagccgggtgatggcaatgaaccattcaaggtagacttcaccgacttcggccgcaagttctggcaagccatggccgagtgccgcgcctggatcgaagagcatggcgtcgatggatacttgaatatggtgtctgaagcgaaccgcgaagtgcagaacttctctatttcggaaatggagaatgcgcgtggcgtagttcgtgacgatacgattgacatgtatctgatcaatgttctgatcagttgcgagttcgaagagatcaagcctggcaggaatgccaagaatcctggatggagggctgacaccgtcgccattctgaaatggttcgatattctcgccaggaagaagccgatttctcgtcaccttactccgcacctgaaggcgctgggattcatcccgaataagaacggcctggctggttggtgcttacctgtcgataaggttgcgcctggatggacgaatggcatgcacacgacgttgccgccgttcaatgatgcgcttgtgtacttgctgagaaagggcgacccggatatcaatgatgaggctgccatggcaaaaattcgggcagtccgggccgagcgagccaagattttgggcgaggatttctgatgtagtggtggagtgtacttggactaggccgccttcgggcggtcttttctttggcgcggcgtacattcgattccggtggtggccgagtgagattcgaaagctatccggtaattagggtggggtggcgacggtgtattgtggaaagttcgtgaacgttggatcgaggattttgtgtggtgagtggatgaattgtggaaaatcgacgattctgactggttttttggggtcggccgcgtcgagcttaccggtaatttacgaaaccaggaattagggtcgagccttagtgccgcgtgggtttgaagggcttaaccggatactttccggtttcggatgcagccgcaaaagtatactacagcgaaaatcgattgcacaatcctaatagaaaaaatctatcacggacgttacctatctttaaaattaattaaattaatagtaatttggtaatttggtatactttggtatttgaaagcctcgctgcactaagcttgtacatatcccgtcaagtttccgattccagccagctcgcggcagggtcgccggaaacttccggacttccaatccatgggtcgcggcaacaccacggcggactaagcggcaaggaccaaaactcgacgaacggaactgggaatttgggcgcacgacaaaatagctcagctggacatatttctaacattcgatttaacactcctctcaaacactcaccaccatcgtcgcccaccaaccgccgactcgatcctcacccaccagcggatcgccagtataacatcctataacaccacctaacactcattcatcatcaaacccacccagacctacagcccacccacaagcagcccatagacgcgatccctggccccatagtacaatcgcgccatactcagtgtcgcgacagagcaccaggtcccatccaccaaccgagccaccgcgacgactccagaatcgaactcagggacgcagcaccaaatgaccaaattctacagccccgacgatctagtcacaccacaggaattcgcagacccgcatttcgcggcgatcaaccaaaagcgattcgacctgtacatcgacctgcgcgtccaaggttacagctcctggcgggtcttccgggccatctggggcgaggagcatatggacggtcccgcgcaggcccgcatcttcgcgatggagtccaacccgtactatcgcaagcagttcaaggccaagttgaacgcgaccaaaacgtccgatttgtggaatccaaagacggcgctccacgaactcctccaaatggttcgtgaccccaccgtcaaggactccagccgtctgtcggccatcaaggaattgaacgttctggctgaaatcacgttcgtggacgagtcgggcaagaccaggatcggtcgcggcctggccgacttctacgcatcagaagccgaggctcagaccgccaccgtcgctgctgcggccgaagccaatggctatgtgccggaaggcgaagagggagatttcccgtctccgacgccggaaccgaccgaggaagaccgcgccaaccccatttagacataaaataacatcgttctaggcccgaatcggaccgaactaaggcgacggtagcgggaagggacgaaaaacgattctagggcggttctaggaagtcgtagcctaaccctcagaaacgacaaagccccggactctagttcagaatccggggctttcttttgggcgccttattcgccagcttcgatgatttcgaagttgtatttgacgccttcgtgctcgaaagtcattttgccagccgccttcagctgcatgcggaagcggatgtgtttcgaagaaggcaggccgaactcgatgaatgctgcgttggtggaccggaactcgccgcgcttgcctttgacagtcacagccacgccatggcgctgagtgcgtttcttggaaacttccgggtctttccaggagttggcgatggctgccgacaggtctttggattctttggctttctccggagcgttcttggcctcttcgcgcatcttccggatttcttccagcgcttcctcttcggtgatctcttcttcaggcttcagattctcttcctcggccttctcttcttccttcttcttggaagtgcgggttttgtagactttggccggggcttcctcttcctgaaaggcttcttcctcggccggcagagcattcaggatggcgaggcagcgacgctcagcagtcttgcggtcggagaagcgcttgacagtcgcatcggcgttgtgagcgttgtagaaggcgaccagttctttcatttctgcgttctggatgtcgccgaaggttttgatggagttggtcatcttgcgatcctctgttttggaagatttctttcgggcttcggtttgtcgccccgttgaaagagattatgcctagatcgatgctgcgtgtctacatttatttcagcagaatgatgatgaacccgacgaacggttgtcggatgtgaaacaccgcaggacaggctgcggtgtttttctggacgatggtgcgacggtcagaaagtcgggactgtgatcggctcgattggcgggtcgccgggcttgtcgttgtccgatgcgggagctggactggacgggatcgcgccggaccgaagcgacagagattccgactgcctgctcacctgcggagccggaggagccggaggagccggaggagcttttggcgcagtaggggcaggcgggaccggcaggcctggaggagccatcggcgccctgggaggttccggaagatcgggaagatcgggaagactcggcgctatgccgccaaaggaccgctgcgactgctgcgccggattgtcgccgaacatttcggcggatcggttgtccttgatgacttgacctatggccgtcttgtcgccgcccggctctgccggatcgaagcccgtgaatggagtggtaacgcagcgcatgttcggatgggtaggcagatttttcagaactatggaatctgcccagacatacggattcttgtggttgccgggtccgtggctgatgatctcggcaggaatatggccgttcatggtaagccattccgccatcccttgccgagtcagcgggcttaccacgatctggccagtagactcttcggcgacggcgaacagatcaccgagcttgaacccgatgattatgtagttggacctggactcgccgacgaaagccagggtttcgatgttgtggtggatatcttgatcttcccagatgtacagcatggtgtcactcctcaataaggttgcttttggtgttcgaccagagacataccggccggaactttgaagcggacgtattcgatcatcatcgccgttcgacgccgattcgtgcccgactcgtcattgacgaatagttcgcactggtgcggaatgactcgcgtcaccaggccttcgcctttcgagccgtagaacttgatgtaggccgcgacgcctcgcgtcatgttcagatggatcgtttcgcagagtcgctgcgcggccgacgcgctagacagatcggccggactgaccgttacccagtaatggccactttgttctttatcggacataagctgccctccaatgagaaagcctctgccgagtcgcagaggctggttgttgttagtcgcgcttcaacagaacgactttgtcatatgcgcgatatttaccgcgccagtcttcccagtagtcgccggccgggcaggtaagctccagggtgatttcgtcgcgccagcattcgacagaaaggacaatcgccttgttcctggctgctgaatctgctctgagcttaatcagaatttcgtcgccagttttcagctcatcgacccttacaactttggccattgcgttctcctattgggtagcgccacgagggcggatcgggtcgatgtcatgtaagcagatggtgggatagtccctggccagcttgagcttgaagtccacccagtcggcaccgatgagcgccgcgacttcgatgcttactttgcggtgcggcgcagctccggatcgcaggactatagcccgacgccgaactggatcatttacgtcgacatgagttagtatttcgtcgccgacgagcaactcacaagccatcaatattttggccatcatacactcctatgagaaggcgcggccaggacgatcccagccgcgccgatggattaacgtttgtgaaggatggacactgcgtccacgtcgaggatgctgatggtacggcgacggcgcggattgctgcgttcatgaatgcgaatcagatcagcagatgcagctttgtccaccacccatacatcttccggcttctgcttccggagcaggaccgtcacctctgtgttctgggcgaggccgttgcagatgaacgtgaacttggacgagggagttctgtacatgtcgagattcctttttggacttcgggtccggcttttcagtcggtgaagagattatgcctgatcatcaccatcgagtaaagcacttgtgtaccaattctccagttaaatggaaccaaagcgcggtatcgctgattgctacgctcccacgccatggcccttcttgcttgcatacttcgaaccacaagctgatttccatccttgccaggactcggccgaaggattcgagccggcgccggctagccaggatgtcgacattcacccgccgattgatttcgtatcggcgaccgttgatgacgaagaccaggcgcagggtgcgtccgtccagacattcccagtatttggtttcataccgaagccagtagcgcttgccagccgggcctaccatggtcatttaatcgatgctcctggccgcgccacgcggtccggtcggcgggacgggatcgaaccgacccaggatgtagtcgggccggcgcgcttcctgaggacacacggcgagaaggcgccatcctgcgtccagagcatgctggagttcgtccgtgcagcagtcttccttgagcagcagacggttgacgctctggagattcggaccagggatggccgagctggtgtgcgagttccaaccttcgatgccgtccaccatctgtggttggttgatgtagccttcggacctgccagccaaccggctcgcggccagctccaggcgttccaacatgggtcgcagagcagcttccgggtcaacgtcgtcccatagaaggaccagattgatgatggtgtacggatagtccttgtccagatcccaggccgaagcggtcagacggcccaggccgatttcattacacatcacgggaacgtcgttgctccaggtggacggctcccagtttcgctcaccaggattcccgattgttacgccttccaggttccccaggagaacgtggagtttgctgacgtattccgcctccagcgctttccgctcttcgtcggtctggttgtggcgatagaaggatggagggctgacttttgcatggtagagtttcatggcggttcctcggtttttgaaggcttgaacgttagagaatggtgtcgcagtatttctcgaaaggactctggcgcttcttctcgcagatcgcgcaggtgatttccaggtcgggcagctcgctgtaagtcttgccgagatacagccagcgcttgcacagactgcggccgtccgacgtgaagaagtggactttgcgagcatcgccgggttgcgcccagccaccttgatcgtttttgcgcttgctcatggcgatatttcctttggatctggaatccatgccgtccgttcgctcacccaaactccgtctacatagatcaggactgacaaagcagtcgcgccaaacccgaagcctacatagaatgaaccgggatcgatttccatggtggcgctattggtggcgctattgaaatcgacttcaaagtcgaacatcgaatggccactcataccgtcaccatgtcgatttcattgatgaagaaatgaacatcgacaccatcggcgcgaccggtgtaacgcagccgagtcgtcccatcaatgtgggcttcctcgacgccgatgacttccaggatggtgtcgttgcagtaaagcttgacgaacatcttgatgccggagccaatcgccgcgaaggcgatctgcttgtacaggtcttgcttgatcatgctttgcgctcctgtttgcggatgtattctgccctggcttcggcttcgaacttcgcccaaagcgcgttgtcgactggaccccagggaccggtctgagtcccgtccaccggcgcgaacttgccaccggcgcgacgatacttggacagagttctcaggccgatgattttctcttcttgggagtcgagttggacgatcatttgacatacttcccgaagtagcaggtgtggaggatttccatacccttggagatagccttcagcttgatgccgaaattcttgatcgcccagtccagatcgtggtgatagaactcgatgatgttgacgatttgaccggcgctgtagtggatgacgcgaatcttaccattccagcggaaatcttcgcggctgtttacggcctcgacttcgatggtgtcgtttctgccgatggtccatttggagctagtcatgtcgcaatcctctttttggagtgtttcgcgtttcgatgaggtaactatacctcagtcacctcatcgagtaaagcacttttgaacagatcatctgaaatttctggaagacaaatccatcggctgattcagtcagtggaaccgaggctccatccattgcgggcgaaggccgagcgaccagacagcttgcgacactggatggagctaccatcgtcgaaggtgtaagatacggcccagtccaggcgctcgcgacgtactgccgcggcagcgatatcttccagacgggctttgagaagttgttctgctttggtcatttcaagttcctctttggagcgcttctggcctcgatgagatgactatacctaagtcatctcatcgagtaaagcacttctgaggaattatctgaaatttctggaggccaggaattgtcgccagagccagtcaacgtgatcgttgagatagcgctcgccatcggacgacagagccaggcagccattctttatgccgagcttggagccggcaatccattcgaactcgaactggagcgttcctgggcgaggggtatgggacatgatgtacttttgcacgatcaggaatcctcgaaaggtttggcgttcgcgatggccgcgattttctgcatgccgatgcgatagaattcggcctcttccctggccttggccagattctccctggcttcgcacgccagcttgtgctggttgttggcattctggatgcttccgtccagactcctgtccagttcttcccgaagagccttctgcgacgctatctcggcctccaaatcctggattctgatctgaagctggcgattcctttcagagatctcgttttcgcgggcgatggagttctgaaggcattcgtcaaggcgagtattttcgcgcaccagctgatgcttttcgactttcgcctttctgcacgtctctcgcattgctgaaagctcactcgcatgcagatcgtcatccgggtctttacgctcttccttcgactccatccgcaggtagtactggccggctgcgaaggcgagcactgcctggtcggcatacgctgcggcatcggtcatgtatctggatttgtagcgaggcagaaacttgcactcctctggatcccagaggagactatcggcaataggccagaatttgcggaagccatcaggatcgacttctacattgaccatttgcagctggccggcctccacttcgacttccagaggaacctgaatggtgccggtgatgtactggaagtacactatgctagacataacacaaactccatgagaagtcgcggccgggaccatcctggccgcgcatcgtaatcactcttcgccttcgtccgcgctcagccactcttcgaaggcgaaattcaccttcgactcgacccaatcctgcagctcatcggcgaactcgtcactgtcgatatccatcggaacgcccagagtttcttcattccacaattcagcattcagctcgaactggaccatttgctcgccatcgacttccatcaggatgcggtctgcgacttcatagtcgtctacatcgaacagatggccgccagtcaggaggtgctggacgaaagcttcatcgagatttgtgacttcgatctggacttgtttggtcattttccgtctcctgacttagcggctttgaattgggctttgaggttggccagttcagctttcagatcgatcatcgcctgaccgcgcaggccttccatttcggcctcgctgatcgcgatcttggctgcgcggattttgtcgttgatttgatctttagtcattttcggcttccttttgtttgaagggttttgcgtttcaatgaggagattatgccgaaagtcagaatggaagtaaagcatcttgatgagaaaaatttctgcccaccgacgaacggtcgtgctcgaccgtcgattgagggtgtgcataatcgaagtcgcacgacgcgaccggtgatgccccggcgaaccggggcggggtggttaggcggtgcgctcggcggcgcgttctgcgttacggtcgtgcgccatgcgcgcccatactgcggcccagcgcgctttatcggcagagttcggcttgtacacgtcgtcagggtgcggttccgggccgtaggcgttgcagctttcgtcgtattcgtaggtcatcatcttgccctcaaggggtcatggcccggcgaaccgggcgggtgattacttgcgatatttcttaatcaggtcgtgtgccatggcgatggcatcagaataggtttctccgccggcctccatttccttcacagccttattgcgcagtgcgttcagcttgttgccgttgatggtgcctttttcatccttggcagcttcgcaggagtcgcgcagagttttcagggcttggtaggtggcgttcatcgtcttgttctccgggtt

SEQ ID NO: 6 - DNA, 66943 bp, artificial sequence
  BP1644
  misc_feature (28341)..(28341): n is a, c, g, or t
  misc_feature (32682)..(32682): n is a, c, g, or t
tcgcgtttcgatgaggagattatgccgatagtcagaatggaagtaaagtgtctgagtgagaaaattctgcacaccgacgaacggttgtgctcgaccgtctgctgcggtgtcgatatactcggcctattgcgaacaatggactgattaaatgtacaaactcaatcctgcgctgcgagcggtctggcgaactcgtgcccgttacaaagtcatctatggcggccgggcgtcttcgaagtcgcacgacgctggcggtatagccgttttcctcgcggccaactacaagctaaagttcctctgtgctcgccagtttcagaaccgcatcagcgaatcggtctacacgttgatcaaggacaagatcgaaaactcagagtataatggcgaattcatcttcaccaagaactctatcaagcacaagagtaccgggtcagagttcctattctatgggatcgcccgtaacctgtcggaaatcaagtccaccgaaggcatcgacattctctggcttgaggaagctcactatctgacccaggagcaatgggaagtcatcgagccgaccatccggaaagagaactcagaaatctggatcatcttcaacccgaacgaagtgaccgacttcgtgtatcagaacttcgtggtcaagccaccgaaagattcctgcgtcaagatgatcaactggaatgaaaatccgttcctcagtgagacgatgctcaaagtcattcacgaagcatatgagcgcgaccgggagcaggccgagcacatttatggcgggattccgaagactggtggcgacaaatccgtcatcaatctcaagttcattcttgcggccatcgacgcccacaagaagctcggctgggagccggccggatcgaagcgcatcggcttcgacgttgcggacgacggcgaggatgcgaacgcaactacgctcatgcacggcaacgtcattatggaagtggacgaatgggacggcctggaagatgaactgctcaagtcgtccagccgcgtttacaacctggcgaagatgaaaggcgcctcggtcacttatgactccatcggcgtcggcgctcacgtcggatcgaagttcgccgagttgaacgatgccagtcccgacttcaaactgatctatgatccattcaacgcgggcggcgctgtcgataagcctgatgatatctacatgaagctgccgcacacgacgatcaagaacaaagaccacttcagcaacatcaaggcgcagaagtgggaagaagtcgcgacccgattccggaagacttatgaagcggttgagcatggaaaggtttatcccttcgacgaattgatttcgatcaactctgaaacgattcacccggacaaactaaatcaactgtgtatcgaactttcgtcgccgcgcaaagacctggacatgaacggccggttcaaagtcgagtccaagaaggatatgcgcgagaaacgcaagatcaagtcgccgaacatcgctgactcggtgattatgtcggccattctgccgatccggaagcccaaaggtttcttcgacttctaaacacagaaaagcccggatcgctccgggcttcgggtcttactcggtgtggttcctggcgctgagtgtcgacgcaacggcctcgccgactcccagggcttcctggccggccgcgagcgcttcggcttccgactcgacgatgaagtcatcaccttggccgtcgcctggcggaacctcgaccagcacggcttcttcgccttcgaaccgcaggtcataagtcttttcgacggacagtccgtaacgggcattgagcgcatcccagagctgagcttcatagttgcgcaggtcttgcagagatttctggtggctgagcatcgccatatcgacggcccgttgcagggtttcgtccaggacgttgaatcgcatgcgaagagaacgaatccgctcgaccacttccgcatccactacatgtctttcgatcatcgcttttcacctttgctgaatgttacgttgtagccattgtcggccaggtaggtcagggcgccttcgaaggaagttccgacgagatgcttgagctgcatttcgcgttgcgcggcgatccagaatgccgttccggagaactctgcgtggccttccgacaataccttgccatcaggcccgtcgatccgaacgtgaacggaagatagcttcagtaccatcaatgaatccctccactggcttgcgacggcatgctttcagcgcgagcggcttcacagtccgggcaggaacaggcttggcggacgcgctccaactcgtcggcatccatgacatagagcttcccatcggaagtgtcgtgcgccatggcgatgttcgggaagtcggcagcgctcaggccggcgacagcgcggatttcgtcccagagcgccacatgctcggcattcaggcgagctgcgagcgcttcgtgctctttcgctacacgagccatgaactcgtccatccggaatgcgaattccgcatcgatggatcgggccgaggccatggagttgaggcgaatcggttctttcttcatggtaattctcttttggttggcggttgttcgctgctcaggcctattacagtctgagcagcatgatgaagatgaacgcaaggaacgcaaacggcacaagtatgccggacatcagctttgacaggagctgcatctcagcgtatttctcggttgacattccgtgctgcgccgcctcagctgcgaagcgggctttcgcctcgataacttccgggcgcagcgacaggacatattctaaggcctcttcccgcgctttttcggcctcgaccgacctagggtcgcgggccgagacttcgctgtgccctggcctcgcgggatgggcctgcagcgatggaggaagttcggcggccacgactccatagtcggcgcaggcccaagcgatcccgatgaggatcgcgaggatggattggacgattcgcagcataactttgtcgctagggaagctcatgatcaatcctccacagaccgaacgatttccaggttgcgcccggcattggtcccggcattgaaggcgcgccgaccgtcgctatcgtccaggcgcatgagcttggtaacatttgacttcttgtagccaggatcgccgaaatgttcgtgcaccgcagcttccttcaccacaaccagagacgttccggcagaagataccagctccatgcgcttcctggtgatggcctgaaggcgatagctgatttcctgggtcgcggccagcttgaattgcgcggcaaccttgacgttgaatcgtccgtatccttgagccttctgatactcccggcacagacgatcaaccgcttcgacaagggagttgaacatgttcaccgccagctcaacgtccgatttgtagcctttaaagcggacggcatgaccccagcgcttcgtagtcccgccgtttgcggcgtgccaagaagccttggcggtcgctcggtgatcgttgatgccaccggcgaaatccatgatgcagtcgttgtacgtcgccacggccaccgagaagaacttcatccagttcgggattgcggaatagtaacgagtcgcgatctgctcatcgaactcttcgcgaatctcgccggtcacttcgaagtcgtgaaggtcatatttgtccttcagcttcttcacacgctcggctgcaatggcggcttcgtgcgggctggaggagtcggccgccatggcagtcagtttgcggatgcggtctttcgccttctcgatggcttccggggtgaattcgttctggtcggtcatggtcggttccttttgtctgaagggtttcgcgtttcaatggagctattctgccttcattcagaatggaagtaaagcactttcttccactatttcggcatcgactggaagaaattccagatccaatcacctgctaccagcaagaggatgagggcggcaaagaacaagacagcggccgcgagctgtgcgcccggcttcagtttgggatggctgagcttgggctctacgggaacggccggagcgctagcgctgcaaccggcgtctcctgggccgtagccgatgccgcgttcacacgcctggagcgacaccagggatttaagatactcggtctgcttttgcgactcttcgtagatgccggcgacggcgaaccagagggcgaacactacggacgtacacacaacccaggcgccggtcagcaggagggccagcgggccgatgacgaagacggtagcagccaggacgattgcgccgccccagatgatgaagccggccagaccattagtgatgtcgacacagaactttttcattttcagattccttcggttacgggatggaggggatttgaaactctgcgccgccgagaacatcaatgacgacttcccagagcgtcggaacagaccactggtaacggtcgaagtcggtttcaggatcgacgcccagcgtcacataggaagtggcaggccatttatgaacactgcctttccgcatgagagtcgccacgcggccgtcaccgagcggattcgttctgtgcggaacgtacgcagacatcgaatattgctgcccggcgtcgataacaaatctttgcctctggcgcagacatacagagcccacaggattccagccgcgaccgccgcaagcctggcgagccgaagagtgttcataaccttcgtgagtcatttcgccgaggcaagccgagcgatcctcgtaatagttgatgttctccatcgatccaaccagtaccagagactcgaaatcgaatctatgatcgtggatggccgagtgattgaagcaaagccggcgcggcaactccgggtgccaaacatggaggcgccctgccgggagctggacttgaatgaaccccaggccgtgcagcgtgatcttgtccttcatcgggtcatggacggtgctcatggataatcctcagtagcagaaatgtatggtgagagttacgatggccaagccggtcgcccataggagggcgaaccaggccatggctttgatggttatgtagatcatccgaagaactttccggcacagatcggtccaatgcccatttcgatggatgcgtggttggtcaactcgcgaccgcagcaggagcattgaccagtcttccggccgtaggcgactgccgattccatcggcttttcaaacatcttcagaacgtcgtcatgctcagtgtcggtgcagtcgcgactcttgatgaatttgccattggtgatccggccgaggtagatgtcgcccaagacgtacaagctaccggcgttccggctgtgagcgctagcctctttcacaataacgatgagcggctcctcgccttcgccagccaggcggattttcgggcgcttgatgccagattctttcgccttctcaaacgccttctcgatgccggaaatgtccagagtcggtgcagcagcttcctgcgcggccactttctcgcgatatttggcgaggttttcgatggcgcgcttcgcagcagcgatctgattttctgtcaaggagccgtatttatacaacgactcctgaaggctctgagcgaagctgaaggaatttccagtccaccactcgacgatgtccgggtgcgcagcttcgaaggctttaattttgaggtcgcgctcttgcgcagcgctacatattttctcgatgcgcttttctgccgccttagcacgactcttggcgcgctgctccgggctggttttgtactctttgtatccaacaccgccgcaggcgaagcaggcgcgaccataagacgaagggccacggtacaggccggtgcctgcgcatttggtgcacttgtcgcgatacagcttcacttccttccgggaattcgggcgagcgcccatggacgcgtcttccagggtcttcggcgcttcgttgttgatcgctacggtagcgaagtcgtcacccaggtcttcgaagccggtgaacagattctctgctgcgttcatatcgattctcctgtttggaaagttcgtttcgatgggttgactatacgccagaaatggaaaacggtagcactttcgcactaccgttcgtcggatcgcagagggtcaggctacacggatcaactgcgacatgactgccaggttccgctcggcgacgccgatgatgacgttggttccgatgatgaacttccaagggtcttccctgttcttgtcgtagaacggatttctgaacagggtccgccatgtctcttcagtgaagaacgttttatggtccaggtcttggtgggcgatgttggagttgtagaatggaacaacgacattgagcgtcgcgccgactgccatggcccgctgcaggtctttcaccaaatcgatgacctgggctccggtgagatgttcgaagaagtgaaatgcgtagaccgccgtcaattcgccgtcttcatacggcactcggccgctggcgccgtcccagttcggccagtcgagcgattcgacgccgggaatcggcgaattgcctgcgcccaggtttactgcgcggcggtgatccggctcgatcaactgagcgatgtcgcgcttcatgccgagtttgaacaggttttgaatatccatttggttctccaggttgctgttagtaaatgtcgctgttgatcttgaatccatgctcagcgccgtcgttgtggtcgtactcagcatagctgtcgcagtagtcattcaaatgctgaatgatgccaagaacgtcgttcgcggccttttgccgtttcgcggcgatggtcttggcgatgctgtcgccgacttccagggtttcggccgtccggcgatggatcagcaggcgactccaaagatagagccggacgcgacgaatgatgtcgcgatggcgctccagtcgtccgtgcaactcttcaatttcgtgctcgcgagattttaatactcgtcgaagctgctgaacttctaattccaaatcggccttagtagccatgttcacctcaaaaaggaaaatcgtctgggactccaggaagctcgacgactattgttgagcctgatcgatctagaatgcatccgaccgagccagccctgtggggatagggtctacacgaactataacaggtgacttccatgactattcgccaggtcgatcctccacaccatctacaaattggcggtcgcttcgacttcagttttcgttcgtccaagacggcgcgtctgtcgcaggaaaggcagcgcgccttaaccgacgtaaccatgggtatagtcgatcattcggatgaggccatcatcctctgattccctcgacttcagaccgcccaaagagtccgactggccgttgcatttcgcatcgatatccatcgaagacaagaatcctgccgatactacggtgatatcaactttgtcgccggccttcttgaagtcttcgcactcagcatcgagggccacaaccgcactcgcagccatgttcacatgacttatgaggtcggggaagatcacaggaacttcacgcgacatgccacggaccgtcatcttcagtactacatacttcatactcactatcccttttgtatgtgaggaaagaatttgctgttttccggatggtggaagcgctcggccgcaggctgtctttcttccggacattgaatcgtcgaaggcgggaaaaccgcgccggcgataatcgccgcgaggagtgcagcggatgtcgacatccagagggcggtttccaggctcacccgaacttccggacggcgcggcttcattcgctccaccctcttcccggttcataggatggtagactgccgccgcgaacccagtcgtcccacatgtggttcagaccagtcggtggctggggcggcggactgtagaatccgggagtctcagtgctgctcaggaaataaggtgtgcaaacggcctggacggccagttggtgccgctcccacatcttatcaatcgctcttagcatgacgtcttcgcactgagtcttactgtcgaaccgtctgctagtatggtccggtatctggacacatccgtctccagtgcaaaggaaagcagtagcaatccatacggtgatactcgccatttcgtcacctctttagttgatgagcagagtctattccatctgctcgccaggagtaaagcgcttttcgtcgggataaatgccgatgatgtctgcgtcgagcatccaaatgtccacggacggatcgtcgctgctgatttgatataggttgtacagctcccgtccgccgacagcacgctcgcctcgcggctcaaccgccagaaccttgccgtggccttctccgtgctcgtccaggtatatgacgtgatcaccgacttcatagctttctttcgtgacgaggcgtgaacgcgagctgttctgcgattcaaccacccaggaatccagcacgccgcctttcatgtcgcggaacaatcttgccgatttgtcgcaatcgaacacgcccagaacttcgccgtctttcaacacgatatgtacgataggaagaagagtattcatgtttaatctccattgactgataattagagtctaatctgccgaaaagttcccgtaaagaattatttctcagaactgattagttgtaactgttaatctgatgtatgtgtttgaatctcttttgaacgtttgatgtttcccctataataagcgcacacagccaacaaccacgtggaactacaatgtttaaactttcctggatattcgggcgcaaaaaggatagtgctgcctgttctgaatcggcgccggagaaagtcgcacaaatccctcaacacgatccgctcgaccctatgattaagctgggcagaattcgcggctggaacgtcgagccggagaaagccccggtcatccgtagcgtgaaggattttctggaaccgggcctatccgtcgcaatggacagcgcgtatggtgacggaccgactccggccgcgaaggttgctgcgggcggccagaatccctatgtcgtcccgaccatgctgcaggattggtacaactcccaaggtttcatcggacaccaagcttgcgccatcatttcccagcactggttggtagacaaggcttgttccatgtccggcgaagacgccgcacggaacggatgggaactcaagtcggacggccggaagctatccgatgaacaaagcgcgctgatcgcccggcgcgacatggagttccgcgtcaaagacaaccttgtcgagctgaaccgattcaaaaacgtcttcggcgttcgtatcgcactgttcgtcgtggagtccgacgatccggactactatgagaaaccgttcaatccggatggaatcacgcccggctcctacaagggaatctcccaggtcgatccatattgggcgatgccgcagcttacttctgcctcgacggccgatccgtctgccgaacatttctatgagccggatttctggatcatcagcggtaaaaaatatcaccgcagtcacctggtcgtcgttcgtggaccgcagccgccagatatcctgaagcccacatatctattcggcggcatcccgctcacccagagaatctatgagcgcgtgtatgcagcggaacggacggcgaacgaagccccgctgcttgccatgtcgaagcgaaccagcaccattcacgttgacgtggaaaaggccatcgcgaatgaagacgctttcaatgctcgcctggcgttctggatcgccaaccgtgataaccacggcgtgaaagttctgggaattgacgaaggcatggagcagttcgacacgaacctggccgacttcgacagcatcattatgaaccaatatcagctggtcgcggccatcgccaagactccagccacgaagctcctcggcacttctccaaaaggattcaacgccactggtgagcacgaaacgatttcttatcacgaagaactggaatccattcaagagcacatattcgacccacttctcgaacgtcactatttgcttctggcgaagtcggaagaaatcgatgtgcagctggaaatcgtctggaatcctgtagactccacgtccagccagcaacaagccgaattgaacaacaagaaagccgctaccgacgaaatctacatcaactctggcgttgtgtctccggatgaagttcgcgagcgtctgcgcgacgatccgcgttccggctacaaccgactcaccgacgatcaggcagaaaccgaaccgggcatgtctccggaaaacctggccgaattcgagaaggccggtgcacagtcgacaaaggcgaaaggcgaagccgagcgagccgaagcccaggcgggcgccgtagagggcgcaggcggcccggttcccgccgctccacgcgggactaagcctctcgcgaaagcggccgaggaaggggccagcgaggccgctgaaccgccgtcgcgaccggaccccaaggccgagctgcggaacttgttggtcgatcttttgtcgaagctccaagacctggacgacattaaggcgccggacggcgtagacatagagcacaatgatgcgcctggcttaaagcgcacgtccaaacctggcgtgtctggcatggagccttcagtgttttcgtccaaccgcatcgtcgggcctcgtgatcattcggaactccagagaatcaaggtgaatggaataaccaccttgatcgaaaatccgcgcggaagcattcgacaaggaaaggatgggagttggcgagttcagatgaaacaccactacgggttcatcaagggaacgaaaggcgctgatggggatgaagtcgattgcttcgtcggtccgaatctgggatccaaacgggtcttcgtcgtcaaccaggtgaacaaggaaggtcagtttgacgagcacaagtgcatgctcggcttcaacaacatcaacgatgcgaagtccggatatctgtcctgcttccgtccgggctgggatggtctcggctccatccatgaagttgacctgcccgctttccgtcgctggctggcgaacggcgacaccaccaaaccattcgggggcgagtgatggcattcaaggcctccaaaaagcgcgagcgccgggcacctcttccagtcggaagagggaagcccataattccatcggcaggaatcgaggcctggtatcgaaagcagatgaaggatatgtccaagctcatgatctccgactatcgaaacgagattgagaaggcactgtcccagcctgcggccgaacggttcttcgccagagacgaatccgttaacgtcctgttcaagatgacccttcgaagcctacagcagcgatggagccgcatttttgaaggtttcgcggccaagatcgccccagagttcgtcaaccggaccgaagaagccgccactgccgcgacccttcacagcttgtcggtggccggcgtcgatcagccacgagctgcgtataatgagagcgtcaggaacaccctggaggccgcaaccacttacaatcatactctcatcaccaagatccaagaggaagtccacgagaagatttacacatcagtaatgctgtctctgacttccccgaatccggaagagcaaggaacttccggcataactaacgcacttcgcaaagtcgggaagttttctgaagatcgaatcgaactcatcgcaagagatcaaacaagcaagctttacagttctctgagcgatgagagaatggcggaaaatggagtcgaggagttcgagtggctacactcttctgccggcaagactcctcgccacacccacctggagaaagatgggaagaggttcaagctgaatgaccccagactttgggagggtccgaaagcagaccaggggccgccaggatgggcgattaactgtagatgcagaaagataccagtcatttgacatcgataggagcgctatatgccgttagttcatggcacttccaatgaggctcgttctgaaaacatccagcgggagatcgaagccggtaaagacccaaagcaggctgcggccatcgcttactccatccagcgcagtgagaaagggaagatggcgaaagattgttcgcctgagctcgttgccgatcttcgcgccctggtggacgctctgtcgaggctcgtgaaatgaaccgcaagacgtgccggcgccgactcgtggtcgatgtaatcagggccaatattcacggcggattcttcaacctgaagtttgccgtcatcgatttggcgatcatcggtgtcgccatcttgatggcttttggccgataatgctgagaaaaatctggattctgactaaaaattctagtccggatagccgcaagttaccgtttacggaaaatagcagtaatttggaaagcctactgccgcgaggctttaacagagccagttcctaatttccgatttagccgcatgctttaaaagtatatagcatgggaaattagaagtaacgttccaatagaattcatctataagcaacgttataatataacgtcaatctatatgctctagacgtattgaaattcaatttttaatcggtaaattggtaatttgaattagtttagaagttgaaagtctcgcggcagtaggcttagacaaatcccgtcaagtttccgagaccaaattaccggattttcgcggctgaggaaactggtaattagatcataatacaaattatagtgtaagttaacagtcgcggctacatctaattattgttccgcttatttacccttggatgtactgcgtatataatacagccatagtccacgactcttcgaattaacgatggcaaagtcgaaaagaaaaattgacgaaaatggatatatgaccatagagggctgcccgatcagctcttatggcgttttccaatattctgctggtcaactcggtcttccgggcgatccgacgcggattgtcaacgtatatcgcccggagtctgccgtcagcgatccggagtacatcgaatctctgaagaatctcccgttgatcgacgagcatgagatgctgtcgggattcgacgatgatgacgatagcgtggcccccgaagacaaaggggtggagggcatcatcacatccaacgcttactacgaagccccatgggcacgcggcgatatccgcatctattcccgcaacatgcagaatcagctggaaaggggcaaagaagacctgtccctaggctatagttgccgctacactgagcaacccggcatctggaacggaacgccttatgaagtcgtccaggaccagatgcgcggcaaccacattgccctggtaaaagagggtcgtgtgccgggggccagagtattggatggtctgtgttttgaccatctcagttttgatttcagaccatccgatgagggtaatgaaatgagtctcaagaaagccaagcggaagccccctgtccagcgcgtagggcaagctgctgactcggcggtcgaagagttgcgcgccctgtggccgaagctatctgcgtctgtccagaagttcctgggcgaagaagagcaggagccggagcatcaggaaggcgcagctccggccgaaccgaccgacagcgagcacctgaccgagcatccgactctggaaggtgctcagaaggatgacgaagagcaggaagaggagccttccgttgtcgatccggccgtggccgccgtcgagccggagcatcaagaaggtgccgcatccgaaatgtccggtgaaggcgaagtcgccgaactgatctctcaagtcaaggccattctggctcgactggagggcacggtagccgaaggggcggacgaagagcatggcgaaggtcaagatgtcgtcgagggcttggaagagcagagcagcctcagcggcgcgcaaaccgccagcgacgatggtggtgagggcaaggataacagcgaggaacttcctgaaatggcacagaagaacgcgcaagatgctgcaattcgcggtctctatcgcgacattgctgctaaagatcgcctctacaagcgtcttagctccgtggttggtgcgttcgatcaccgagctatggactcggctgaagtcgctgtttacggcgtgaagaagctgaatatcagctgcgcgaagggccaggaagcactggcgctcgacatgtacctgaaaggtgtcgaagccgcgcgcggcgcggccagccgtcaatcgaaagcccaggattcggccggttctgctccgcagtgcgccgagctggacagctacctgaagggggagtaactcatgttccagaaacaagtttaccgccagtacactcctggttttccgggcgatctgatcgaggacggcccgaagcgggcgcggccgggtcgaatcatgtctctgtctgccgtaaatccggctgccaccgccaccggccccaaccgcatcagtcgcgctttcggttacgccggtgacgtcagctccctcggcgaaggtcagccgaagactatcgcggctcgcgcttctgaagtcgtgatcggcggcgccaacttctttggtgtcctcggtcatccgaagcactatgcgctgttcggttcggccggagactccctggctcccagctatgatctgcccgatggcgccgaaggcgagttcttcgacatggccaccggcctggtcgtcgaaattttcaacggcgccgcaaccgccctggacctggactatggtgacctggtcgcctatgtaccaaacaacctgcctaccgccgacaacgcgcttggcctgccggccggcgccctggttggcttcaaggctggctccatgccgaccggcttggtccagattcccaacgcacgcatcgttaacgccatcagtctgccggcccagtcggcggggaatctggttgctggcgttaccatcgtccagctcacgcagtaaggaggcgtcatgagccagatcagcaagacccattcgcgcctcgcaggccgcaatgcgaaacctttcgacctgaaaaacatcaccaatgacgccgtggcgtctctgcgccgcatcggcctggtattcgatcacgccgtcgtccaggaccagatcaaggccttggcgaaggccggcgcgttccgctccggctcggccatggacagcaacttcaccgccccggtgaccacgccgtccatcccgactcccatccagttcctgcagacctggttgccgggcttcgtgaaggtcatgaccgctgcacggaagatcgacgaaatcatcggcatcgataccgttggctcctgggaagatcaagaaatcgtccagggcatcgtggagccggccggcactgcggtggaatacggcgaccacaccaacatcccgctgaccagctggaacgccaacttcgaacgtcgcaccatcgttcgtggcgagctgggtatgatggtgggcaccctggaagagggtcgtgcctcggccatccggctgaacagcgccgaaaccaaacgccaacaggcggccatcggtctggaaatcttccgcaacgccatcggcttttatggctggcagagcggcctgggcaaccgcacctatggtttcctgaacgatcccaacctgccggcattccagaccccgccgagccagggctggtccactgccgactgggcaggcatcatcggcgacatccgcgaggccgttcgccagctgcgtattcagagccaagatcagatcgatccgaaggcggaaaagatcactctggccctggccaccagcaaggtggactacctgtcggtaaccacgccttacggcatttcggtttcggactggatcgaacagacctatccgaaaatgcggatcgtgtcggctccggaattgtccggcgtccagatgaaaaaccaagagccggaagatgctctggtgctcttcgtcgaagacgtgaacgcggccgtcgatggcagcaccgatggcggcagcgtgttcagccagctggtacagagcaagttcatcaccctgggtgtcgaaaagcgggcgaagtcgtacgtggaagacttctccaacggcaccgccggtgcgctgtgcaagcgtccgtgggctgtggtgcgctacctcggcatctaacagatgcctattcaccaaaggccggaagcccggcctttgttcactctgactctaactcggttgtaggggccggttagggcataattactaggactacgccaatgactgtttatatcgtttcctccatgactcaatcggtgtcttacaatgcgtatgacacctctgatccgtccaatcctcgcctccagcgaaagattctgattcgcggccgcgcaggcatcgcatccgaaacttccggcttcggcgacatgatttccgacgaggcaggacgtccgatctggaccccacagggcgattgcactgccgtgagcgattcggatttcgagctgcttcaggccaataagattttcatgcgtcacatggagaagggttatctgcgagtcgtgaagaccgacatcaccagtgaccaccagcggatttccaaagagactcgcaccatggagcgcgatggattccagcctctggatgctactcgcctgcagcagaaaatcaaggtgaccacagccagcgcttcccaggaacaagagttccggatttaaccgagggtttcggcatggtgattttcgacgaaaataagtttcgcacgctgtttccggagtttgctgatccagccgcttatccggacgtgcgcctgcagatgtatttcgacattgcgtgcgaattcatttctgatcgcgattcgccataccggattctcaatggcaaagccctggaagcgtgcctgtatcttctgaccgcccacctcctgtcgctgtccacgatgcaagttcagggcgcggctggaggtggcgtcaccgccggtggaacccaaggcggtttcatcaccagcgctacggtcggcgaggtcagcgtggccaagctcgcgcccccggccaagaatggttggcagtggtggctttccgggacgccttatggccaagagttgtgggcgctcctcagcgtcaaagcggtgggcggattctacatcggcggtcttccagagcgccgaggcttccggaaggttggagggacgttctggtgatccctggtgcgaatcttctgcgaatggccttcggggtcatcggtactcaaattgtgaaatatcgcaagtttgagcagcgagtgaagaatgatcaagcccagtatgtctccatgttcggggagcctttcgacctggcagcgtctgtccagcgagtccgacgcgatcagtatgcccagtttaatctggagttccaacggaattatgttatgatcttcgccaactttgatatggttgacttggatcgcaatatggccggtgaccagttcctctggactggaagagtttttcagctggagtctcaaggctcctggttttatcaggacggctggggagtttgcctggccgtggatatcggtgcggccaagctcactgatgacgggaaaccgactttctaggtggtgtatgtttgacggcgaactgatagcgaaaatggttgtcgagctgaatgcggcgatggcatctgctcaagaggctttgcagttcccggattttgaagtcgtccagaaagctcagccgacccaacaggggacgtcaaccaggccgaccatctttttccagaaactgtttgacattcctcgcggctggcctgccaccgattggtacctggacaacacggcccgcaaatatgtggaaataactcgacagcatgtagagacgactttccagatcagttcccttcattggcagaatcctgaaatcactcacgtggttacggcttctgatatcgccaactatgtgagagcttatttccaagctcgatccacaattgagcgcgtaaaggaactggacttcctcattcttcgcgtgtctcaaatttccaacgaggcattcgagaacgacaatcaccagttcgaattccacccaagttttgacatggttgtaacttacaaccaatatattcgcctgtacgaaaacgcagcatattcggccgatggggtattgataggcatatgagtctgaggcgcgattcagagctaatcgccgcgcacctccagatgttaagagccatgcgcggcaggtccgtttcagccggatggtattccacggctcgatatcctgacaaggcaggcggatcggtcggaatacaagtcgcgagaatcgcacgtctcaatgagtacggcggaactatcgaccatccgggcgggaccaggtatattagggacgccattgttcggggccggtttgttggcgttcggttcgtcagaaacgactttccgggagaaaccgaggtaactaagcctcacagaattaccatcccggctagaccgtttatgcgatatgcttggaacttgttttccgcagatcgcgccgcaatccagaaccggatagccatgaggctggccagaggacagatcactccagatcaagctcttgcccagatcggcctggcattggaaggatacatagccagaagcatcaggaccgggccatgggtggctaactcagcatctacggtcaggagaaagggattcaacagaccgctggtcgatacggcgcacatgcttcaatcgattagcagcagagtaacataaccaggagatcatccagtgatcagtcagagccgttatatccggatcatttcgggcgtaggcgcaggcgctccggtcgcaggccgaaagctgattctgcgcgtcatgactaccaacaacgtcatcccgcccggaatcgtcatcgagttcgacaacgccaacgcagtcctgtcatacttcggcgcgcagtcggaagagtatcagcgggctgcggcttatttcaagttcatcagtaaaagcgtgaattcgccgtccagcatcagcttcgctcgctgggtaaacaccgccatcgcgccgatggttgttggtgacaatctgccgaagaccatcgccgatttcgccggcttctcagcaggggttctgaccatcatggtcggcgcggccgaacagaacattaccgccatcgatacgtccgccgcgacttctatggacaacgtggcgtcgatcatccagaccgaaatccgcaagaacgctgacccgcagctggcccaggctaccgttacctggaatcagaacgccaaccagttcaccttggtcggcgccaccattggtaccggcgtcctggccgtggcgaaatctgccgacccccaggacatgtccaccgccctcggctggtccacctccaacgtcgtcaacgtcgccggccaggctgccgatcttcccgacgcggccgttgccaagagcaccaatgtcagcaacaacttcggttcgttcctgttcgccggtgcgccgctcgacaatgaccagatcaaggccgtgtcggcctggaacgcggctcagaacaaccagttcatctacacggtcgctacttccctggcgaacctcggcactcttttcgccttggtgaatggcaacgccgggaccgccctgaacgtgctgtcggcgactgctgccaacgacttcgtggagcagtgccccagcgagattctggctgccaccaactacgatgagccgggcgcttcgcaaaactacatgtactaccaattccctggccgcaacatcactgtttccgacgataccgttgcgaacaccgtcgacaagagccggggcaactacatcggcgtcacccaggccaatggccagcaactcgcgttctaccagcgcggcattctgtgcggcggtccgaccgatgcggtggacatgaacgtctatgccaacgaaatctggctgaagtcggctatcgctcaagcgctcctggacctgttcctgaacgtcaatgcggttccggcgagcagcactggcgaggcgatgaccctggcggtgctgcagccggttctggacaaggcgactgccaacggcacgttcacctacggcaaggaaatcagcgccgtccagcagcagtacatcacccaagtcaccggtgatcgccgcgcctggcgtcaagtccaaaccctgggttactggatcaacatcaccttctccagctataccaacagcaacactggcttgaccgagtggaaggccaactacacgctgatctattcgaagggcgatgccatccgcttcgtcgaagggtcggatgtgatgatctaatggtttgcggcggactcgatccgccgcgaccttccataaatggagtgaggaataagcaatgatcaacatttctgcgttcggctcgatctgccagttcacggcaagcagaactttcccgaacggattcaccgtcaccgagttcgccgacgatgccgatcccatcgacagcccgccgttcaccgctgccgataccggcgtcggtctcaacggtgacatggtagtttggaaccgggcgaacatcctggaagtagtcgtcaacgtcattccgaataccgagggcgagcgcaacctggcagtcctgctggatgccaaccgcaccggaaaggacaagtcgggcgctcgtgatgtcgtcggtctggtcgtggcgatgccggacggcagcaaaatcacctgcaccaacggcacccccatcgacggcgttctgatcaacgcggtggcaagcgtcggccgtctgaagaccaagccgtatcggttccgatttgaaaaagtgatcaaagccggtactagctgatgaagaaaattccgctgacagcagtccccaatcaagcgatctcatttaacgccggtagcagctattggaagattcgcctgtaccagaacatggacatgatgaatgccgatatcagccgcgacggcgtgatcgtttgccatggggtccgctgcttcggcgggattcctcttctccagtacagccatcagtaccgacctgactatggcaatttcgtcttcgaccgcgacgccgattggacgttgttcggcgacggaatcaacctgttctatctggacggcgccgaattcgcagagtatcaggcgctcgccacgaggaaagaatgagcacatcaacgatcagaaccgggacgaacaatgatatccttttggacgacaatggaaacatggtcatcctcagggatgtcgaagcgtgcgcccaggacgttcgggcggcgatgctcatgcgcaccggcgaaaatattttcgatgtgaactccggcgtgggatatttcgaatacatcttctcgccgcagaaaagctatgatgacgctcgcaaatccatcgcggatgcaattttgtcctcgccggatgtgaccggcatcgagcagctggacatcgacatcaccggggaagtcttcggcgtcgatgcgaaagtcatcaccatccacgggcctgttaccacaggagtttgaaatgagtaccatccgcatccaatacgccaacggcacccaactgttcctggacggcaaaaatccgccgcccctggacccgctgccctcgtttaacccgtctgtcgaagatctggaaggcctgggccgcgaaaagaacaccgacaagggcgactcctcgccggccggtcttcccgttcccccggtagacgtcgattccaatgtcgacaacggcggaaccatcccggctccggtatcgaccgacgctcctgcggccgaatcggccccggaaggcgcccaggaagctcctgcagcaggccaaggcgacgagaaaggcgccgaggaagcccagactaccgccccagtagaaaaggccgaggaaacggcctcgccggccgctgaagaggcaaccccggctcccgccaaggccacctctcgcaaaaccaccagcaagtaaggactcgacatgatcaacgtcagcggcttcggcacaggaattgtaatagtttccgcctcatcgttcccgatggggttttccttgtcgaagttcgctgatgatgagagtccgatatcctccaaagagctggagccgttcggatatgagatgctttatgacggcggcctattcgcctttgacaaggctgctcctctggaagtatctgtatccgtcatcgcagggagcgaggatgatattaaccttcgcatccttctcaattccaaaaagggatcattcagatttcttccgggaatcatcccggacatgacgactctcgtggccactcttcctgatggcggccgcaccgttctgtccaatgggaccatcctcaagggtccggccatcgacaccatacagaacaccggacggcgcaaaggcaacacgtacacttttgttttcggtagctatcttggcgcccagactgcgcgtcaagccatttctaacgttatccaatcggtactggaggtggtctgatgttagggattttcaccagcctcctaagttcgcgatctttttcgattgtggaccaaaacacaaaccagctagttgctgcggatttgaggataagccgggtcaacacccggttttcttctgtaggacaacgccacatgctggaagatggtacgaccaagatggattccagaacgatccaccctatggaaatcatcgtcgaagtattttgcccttcaattggtgtcgtcgatcagatcaatcaattgctcctggatcgcgacacactgtacaaagtcatcactcgcggcatggtattcgaacggatgatgtgtaccagcgaagcgctcaatcagactccggatgtgatatcggcgactcctgcacggctgacattctcccaagttctcgtccagaatcccaagcctataatgttccgaaatgcaggggactcttctatgatcgaccgagggctggccctagctgaagacgtggttggctcggccggcgatctgttcgactacgcagtgaacggcgtccagaacgccgcagacttgttctgaggtgccaattgaactctttcctcaagtctattctcaacacgcctactctcaccatacgcgatgatgttaccaaacttcctgtctggaagagtcttcaagtcaagaaagtggaaatttactcgccggcttccgtagtgtcgaaacctctggcgacgaaagaccagacggaagctcaagtgtacaccgaagctctggacattgatgtgaagaatggaaagatcatccaaccggtgcgactccgcatcaatgctatctgtccggacctgtccaccgttgaaagtatcatgaacgctttcaatgataacacctcgactttcgctatcacttctaagtcgatattggccgataaaatggccatcatgacgctcgatgtagatcagtctccagacatgttgaacgcggctgagatcaatatggaattcgagcaggctgagcctccagtattgaataaattcgatcctgcgttccctcaagatagtccgacttatggggtacagattcaatctctttctgatgctaatttgctggattttggcgccatcggcgattcgatatcttcggccgcaaaatcgctatataatcgcgtgaccagctacttctgaggatgtatcatgcttgaaatcaatcttcccgatggccgtcaaactcgcgtacaaatcgaggcgtggtcggcattggatggctgggacctccagcgccgtttcgtcgaattcgctgtcagccaagattccgacttccgccgctctttcaccatggaaatcctgggctatgcgaaagtgctgcttggcgacgatgacaccggcattccgctgaccaccgcggcagtcatcaacaaccacctcggccactggaagaacgtggaactggttttcaactctgttctcaagcacaatggcatcgacccggccacgcacgccgaccggccggactattgggaacaagtcggatcgcagatggccatcgcatttctggccgaggcgtccaagctcattggtccagcaatgaagatcgccgaaggactcgccaacaagccggagtgattcatgtctagtgatttggatgaattcatacttcggtatgaggccgatactgccagagccgagcgcaatctggagcgcctccagaaccagatcaggcgcgtgaacagcgcatcgacgagtggccttcaggatttgcgccacttcgcagacggcgcggccactgaactcggccgagtcgttccgcagatcgattctgtgacgagcgcgattcgcgggatgaacgcgcaactggcgataggcgccactggcgtggccctggtcgcggccggcgtcaaggcgttcatgaacaccagggaccagtacaatcagcagcgcatccaggcgatggacatcggcatcgccccggcacgcttggaagagtaccagagaaaattcgttcgccagtccggtggaaccatcagccgcgagcagggcgcggagatgaccaaaaatctggcagacactttccggcgtgcttatcgcgatatcgggcgagtcggcccggaagcgcgaattctgcgtatggccggcgttgatgtcgggagcttccaaaagggcatgcggccgctcaacgacatcattactgatctggccacgaaaatggccaagctgaagccggacgaaatttctgcctacgctgatgcccttggcgtctcgcgagactacctgagcaccctggctaagatcggcccggccatgggaaaagtcaccgagatgacgactgcggaactccagtccagggtccagggcgagtccaacattcagaaattcaacgatgctctggcgaatctcaaccagacgttcaccaccctggaaaaccgagtcggcgaaaagctcgcgcctgcgttcaccaagctgatcgaaatcatcgacaagatagtccaggctattcccaatgaagtggaaagcttcgcgaaggacaccaaatcccgttgggaagatggagtgctcgggaaggcgaccgttggcagtgatatcctatccctcctcagccccggcgccctgctcggtcgcctggcagcgtgggggactcgtcgcggcatggaagaatcagggctcatcgacaaggacaaggttcccggcgctcaaaccagcgaagacctggccaagaaacaagaagaccaggacaaggctactaagtccatgaaagagctagagaagctggctgaccagaccacgaagtctaccaatgattttgcggtggcgatcaacatgttcagtggcgcggtatcgtcgttcgcgaatgccgttgacgagcgccaagcttgggcagcctgggcgggggaaattggtcgggcggtcggtatgggaagcaccgcgccgacttcgcgggcaaccggcgtctatccgcacgcgatctatgatcagtcgaagagtggcgcggccggacaagtcttcggcgagccaatcggcgcccagtctcttcgcaatcgcatgttctcgccgcagcgcaaggcagagccggtcaccgttccatcgtacatcaacgatatcatcaaagatgcttcgaagatgtacaacattcctgagctggacatcaagaaactcatatacaccgaaagccgattcaacgccagggccaccagcgaagccggagcgaaaggcctcatgcaactgatgccggaaatcgccaaggcgtatggtatcactgacgtatatgaccctcgccagaacatcctcggcggaacgcgcctactgcgtgaaaacctagatcgagcaaatggcgacatgcggttggccttgacatactatcatggcggactcgatccgaagaactggggcccaaggactcgcgcatatccgggtttggtaatgagcgctccaatcgagctgatggaagaggctcagcgcaagcagaaggctgcggccatgaccgtcgccaacgagacgttcgccccggaaggcggcgacatggacattcgtccctatgatggcgggcgactggaaaccccagaccagggcaagaaggaagatgagcgccgcgaagcccgtcgatatgacgacagggttgtgcgaccggaaattcgcatcatcgaccgcatgccagaccgcagcgacggcgaaatcctcaagatgtctagacgtcaagaggccgaccgggcagattctggattccggaagttcccgaatcaagttcgcggcgagaccaagcagaacatccaggctcaactcactgcaggagccatcgcgcaagtgatcggcgttaaccccaaccagatcatgcgccgcgaaatcagccgttctgacttgctgttcggatacaaccaagccatcctgggcaagcaacaggagatcaaggccgccgcgaccgaagccaacaacgtattcctgtctccagccaagcttgccgaagccacggccaaggtgaacgccgcatcgcgagaaatggatattctcaggacgtacggcgagcaacttctgaagagcgctccagagcgcggccaggagctgaccatcggtcggatcgacatgttggtcaacgtcaccggcgcgaattctccggaagaggctcgtgagatattcagcaagcagactgcagaccagctgactacggcaatccaggacgctcaaaacgattccgcaactaagatactctactgatgaaaaagagaattctgcgagtaacattcaacatgccttatggacccgaagtcatccgcgaagatctggatgttcgggtccggattatgaaggctgcgttgcggattcagaaccgggcgacgatggaaattttcggcctcaccactcagctgcgcgagtctcttctgtcgcagttcaccgcgtggaagcaccggcaacgtcaagtgggcagggaagatgaattgatgatcaaggtgtcggtggaagccggctactctgaccaggggcgcgagcaagtttccagagtctttgtcggcgaagttgccattgtcgatatcatttctccgccacctgacattggaatccgcatccagtgctataccaggcaaatcgacaggacgaagaccattcggaatatgccgcccgccaacacgacgtttgtcaagttcgtcgagtggggcgcgaacgaaatgggattgaacttcatctgcgataccagttacaacgatcaagttctgaagaatccgggccggtctatcactgtcgcgtcggcaatcctggcgtcgattcaggatatgtacatgccggacgtggccgcgttcgtcgatgatgacatattgatcgtgaaggaccgcgataaagtcattcgtccggatgaggtgaccaacgtcaactcgtttgttggaattccatcttggtctgaatggggcgtggaattccagtgtctgtttgagccatcgattcgtgtggctggaggcgtagcggtcgaatctctcatgaatccaagtgttaatggtaactatgtaataactgctctggaatacgagttggccagtcgggatcggccgttctatatcaaagtcatggggagtccagcagcataatggccagggaaatcaaatcattcaacatgttcggagttcactatacttcgcggcaattctctgctgtcgatgggctcagcatgatgtcggaaattcagaacgtgccgccagaagaattgctcaagggtactgatgtattggcgcatccggaagaccatccggaaggcatctggcttccattgactgctgcgaacatcaatctttatgtcgttgatcgagcgaaagtaatagctcccgtacaagttcttgcacttctgtccgaagtggtaatcgactggaactttggttttctcaaagactggaccggagtcaagattccatccagatttgtcgaagatatcaaaagcgtgaagacggcacattcaccttctgtagttgcgagcttggtcgcgaacggctcagcctctatgcgcgagttggaagagtattattcgactcaagatgcgtttaagatgatagacatcatgacggcgaagagcgtgaacgaggccttggcgtccgaagcatcgcacaacagaatcaaaaagggataattcctaaccgggcctgggaaggctatactagacctgccaaatcagaggctttcccatgtccaatatttctctaacatccgcaaaagctcccgacaggacgcgactgatcgccgctcttgacgctcggtcgcggcgggatgctctagatttcgaagtaatgataccggctcaggttgttcaatatgacagggccgagaatatcgcgacgattcaacctctcatcacctgggttgacacggaacacaacgccgtccaaaggcatcagctggttgatattcctgtaatttccatgggggctggcggcttccacataagtttcccgattcagcaaggtgacataggctggatttatgcggccgaccgcgacacgtctcagttcctggagtcgttgtcaatgtcgaagccgaacaccggccgcatccataagttcgagcatggcctgttcatcccggacgtattccgtcgatacaccatcaattccgaagattcggccgctatggtcatacaatcgacttccggagcgaccagaatttcgattcgcggcgacaacatcaagatcactgcgccgtcgaatgtcaccgtggatactccgcaggcgaatttcactggtgatgtgactatcgctaacactctggttgtaaacggtatcaacgtgaacaaccacggccacctcgaaaacaacccgcctgatgcccggacgaagggcggcatgattgcttaaggagaatttcatggcaagttttgatttttctgatttaacagcngggggggggttgtaatggctaactacaactacatcgtcgatactggtgtgatagtcgcagataccgccgacgttctgagtgacgttgaagccgagttccgcgccgccctcggtgccaatatcaacttggccgcgagcactccgcagggatcgcttgtcgcggccgaggccatcgcccgttccagtgtcatgcggaatgaagcgcgaattgccaataccataaacccgaacgtttcattcggaacgttcctggacgcgatctgtgccttgatggggatcgagcgcggttctgacctgtcaaccttcggctatggagttcaagtcaccggccgcagccaaacccgcatttccaccgggtctagggtccagactccggccggcgcgatcttcacagtgatgagtgatgtcacgattcctgctggtggtgtcgcgaccatcgatatcaaatcgcaggagtatggcaacattcctctgccggtcgggaatctcatcatcatcgacggaacaattggctggtccggagcgaaagtcatcacctccactcgcgtcgatccgggcagccgccaaatgagcgatgcagagttgaagaatgcccgcgttaatcgattggccatccaaggccgcaactcgactatggccatcaaggcgtatgtgagcgccgttccaaacgtcacgtcggtgaacgtaatcgagaacaacaccggcgccgttcaagtggtgaatggagtctcgtttacccttccgtatgctgtttgggtctgcgtcgccggaaacccggataaacaagcagtcgccgatgcgttgtgggccgcccataacggcggaactccatgggactatggtgcgacgaacaacggcgtcccggtggacggtccgaatggcgttcctgtgcgcgatccggcgtccggtcgaaagtatgtcgtgaagtggaccactccaattatgtacgatggatatgttaacgtaacagtccagcaaggttcctcctctgtagctccgggagccattcagaacgcagtggtcaattacgcccaggggaaagtggaaggggaagaggggctggtggtgggcgcgagcctgtcggcattcgaagtcgccggcgccatcgctcgcgaaattcccggcatctacatcaaactctgccaggtcgcgtgcgtcgcggctggctcgccggctccggctccgggcgatttcacttcggaatacgtcatgagcgcattcggccaggctaccatttccgttggtaacgttcgggtgactttcgtatgactctgcctgcgtacaattcggacatccaacaagctctgaaatggctccataaccaggcgcctggaatcaccggcctgatccagagaaaggcgcaatggtatgacagattcagccgccaattctgggccaactgggagcgcgacgttttccacttgaaaactgccaacccgttcggcctcatggtgtggtgcatcatcctcggcacgccgtcgaaaggattcggcctatatccaaaaaacagttcttgggcattcggtcggctacgccagaacttcatctatagcggtacacaagttccgccaccggcagacgcatcgcctggaggcaacttctacggtggcggcaatgccgaaattctcaacttggacgaaatcaggaaagtgcttcagctaagatatgtagcgctgatttcgaacggctcgattgcatatatcaatcgcatgcttcgttacatattcaatgatgatgagccatgggacgaggcgaccggtctgtacttctatctcatggactcaaccggcgagaatggccctgtggagaacttggcagtatatcggaaagattgggaaggtatggtgttgttgtccagttcgcccagaacgaaccacgtgctgacatcgacccctgccagcgacgccgattggccaggagtcgatccggccgcgagcggtcttccggtaacggtcgaaacggcgtccgctatggccccggacggctccgctacggtgtgcaagcttactaagccggccgggagtaccgcttacgtctccgcgccgatagatgggccgctggggtccggtagcactgtaacgttctcgttcttcgcgaaagccggctccacccgtttcattgcaattcagtcggctgccgatttccccagtcgagccgatgccgttttcgacctggattccgggaacgtgatcagcgatcagatgttggacagcagcgtggtaagcgcccgaatgattcgtctggagaatggctggtggcgttgcgttctcacgaccaagaccgtcagctcttcgttccgcgcggcttacatcgctccggcagaaaccaacttcagctggattgattcgaattccagcgcggcgattgatgtgcttatctggggcgctcagatcgagcttgacgatgttcctaccggatacttggcgaccaccggaacccctgccaccatcactgattatgttctgcagaacatccaaaccggaacggtcaagttcacccagcctcttccgactggagccgaagcgtattggactggagactggaaaggtgggactgcggccgagccggccagattcgcagtaggggatgggattcaagatacattcaatttgtccagtcctgcatacatcggcctacccactagtggggcgttcaagctagaatacagagttggtccggcgcttaatttgtcgccgcaattgatcaacctcatgaatgaccgggcagttggtatcatgccgacttgcgccggttgcgatgtaaaagtcattcaggagtaatgacgtgatcacacccgaactgatacccagtccgtttgctgcgcagggcgacaaagacccgatcccgcagacttcttccactggcttcgctaaccttcgcgacggctacacgccggactacgaaatcagcctggcgtcgaacaacccgcaggccaaagcggtcgagcgaaagattcaaaaccaactcttcttcatcgcgacccagaacgcacaggcgtggcagcggcaaatggcgccgccgtggtttcagggcatgcctggcggctatgaacagaatgcagaagtcgtgcgagtcggcaatgacggcataatgcgacgttatcgttccatggtgaatgccaacgcgagcgaccctctcagcagaacgacttgggaagaacaacccgcctggtcggtgatgcgctccaacataccgatgccagctggagggccaggcctatcttctggcggagaagtcatcacgaccggccgcaacttcaatgacctgttgaatgggacgtgggagttcttctctgattcagtggtcgtcgcttctcagaacgcccccgtatatcccgcttcggctggtgccgctgctggcatgttggaggcgaaatcttgggtgtccggagccaatacgttctgcgtccaacgctacactgatcgcgtcgggaacgtcgctgtgcgcgggcttaatgccggagcgtggaccgactggatgtatgcggtaaacgtcatggcccttcaacaaggtcgggtcacctatggagtcgcggccggatcggcgaacgcttacacgttgacgctagttccgcagctccaaggcggcctggtggatggcatgattcttcgggtcaagttcaacaccatgaacaccggcgcctccaccatcaacgtctccggactcggcgccaaagccatcgtcggcgcggccaacttccctctcaccggcggcgaacttggccaaggactcatcgctgagcttgtattcgacgcagcaggcgaccgctggagaatcctcgcaggcgcgccacgcatccaagttggcaacgccgatcaagattaccaggcccccagctggaaacaggtgaaggattacgtcgcgtcccaaaagctgactgaagtggactgggctgacgtcgtcaacaagccgaacgtcgctatccaagacaccacgccgtggttcgccaatctggagctgtccgatgctcggcctttcatcgatttccacttcaacagcaatcgcgccaaagattttgactatcggctgatatctgaagcagacggatcgctggctttctattcgcggcaggggtctgctgggcctacccaggacattctgttcaaccgaaattccgtgactttcttccagccgcgactcgatgtggcgaaaaacctcgcgtacatcgcgaactctggccccctttggcagaacaccaccgccgatcagcccggttggaaattcacctttgcacaaggcgtggacgcgaacaacaacgcggttattttttttttttcaagcagaagacggcatacgagatgcctaagtgactggagttcagacgtgtgctcttccgatcssncbacgtthrgctgatatctgaagcagacggatcgctggctttctattcgcggcaggggtctgctgggcctacccaggacattctgttcaaccgaaattccgtgactttcttccagccgcgactcgatgtggcgaaaaacctcgcgtacatcgcgaactctggccccctttggcagaacaccaccgccgatcagcccggttggaaattcacctttgcacaaggcgtggacgcgaacaacaacgcggtgatcgcagtcaataccaccaatccggacggttcctatcgttcacaggtcatgcgatgggactgggcgtccacgaacgtcatattcaacaaccgtccgctcttcgccggtcaatacaccccttgggattctgggaacttcgatccttccaccaagttgacggtgagtgccacgaaccaaatcgccggcccaaccgggattcggaataccaacggcaacaccggcaacatgaacacctggggttccggctccacgacggcatcctatggcaatgctgccattcaaatcttcggaaaagggggcggtgagcctgccgcgatctatttcgacaactcccagaccggatggtatctgggcatggacaaggatggacagctcaagcgggccggctggtcgctcggcaataactcctatgtgatcaccgacgaatccaacatccgaacccatatcaacacaatggctgcgcgcccgatttgggggaatgtcgagttctggggtccgtggaacttcaatccgaacactaagcttacgttgggcgcattcaacgatagccaatacaccaggatggtaaacagcgccgcgaaggacgtagggatagccgccatgacaagttatggcgacgcggctatgtcgttcttcaactatgaggcttcggcgccgaccgggaatcgtgctgctgtaatttcgtttgttcgtaacggggcacgaggcgttctgttcggcctggacacggacaacaagctgaaatggggcggctattctctaggtgccgtcgcgttcgagattgccgactccaacaacctcatgagcctgtggtcatcccacgctgacgcgccgaactggaacgggcagaccatctggaggtcgggaaacttcaacccagacaccaaggcgactttggcagctcgcaatacgacgtcatcccctacaatattcagttatggggcgtccggaatcgcatcaaccggacaggtcggtgcgttggttgtggaaaacaacagagtcaccaataccgcagccgccatcacgttccattcgccgcagaaatatcaggtcaacttcggcctggatgcggacaacgtggtaaagatcggtggcggcacaatgggcggcgtagcatatcccatcatccactccggcaactacaacgactacatcaaccaggcgctggttcaggtaggtcttggcggcgtcggttcctatggcatctttgcggttctggactatgccgctccaaccgagaccgttcaaccgggagtggttgtggacggttccattctcatctactcgtcttgcgccgcaaactacaatagcggtaaaaggcctgccggaacttggcgctgcatgggatatgtagtcaaccgggatgccaacactcctgactccgcgacccttttccagcgagtgacgtaaaatgaaatggacgcggatcagaaaccctcgttggctggatgaaacaaacatccacgccatggtgactttcgatgggatcggggaagttcctttcaccgccaatccgcacgatgtggaggcccacggaagggccatccacgctgcgatcctatccggggcgcacggacctatcgccccggtcgatgcgaagcgggagcaggccttgcaggacgctatacgggccagggaaaagcgggctatccttcgtgatacccgctggcccatagatcgtcacgacgagcagaggcggctgggtatcgaaaccacggacggacctgggttgatagcagcccttgttcactggaggcagcagattcgcgattggaatagcggggatcggccgcgacttcccatggctctgaaaacgatgttcaaaaatcaggagtattgatgaaaatcacaaaggatattcttatcaccggaaccgggtgcaccacggatcgggcgatcaagtggctggatgacgtccaggcggccatggataaattccacatcgagtcgccgcgagccatcgcggcctacctcgccaacatcggcgtcgagtccggcggactggtaagtctggtggagaatctcaactacagcgcccaagggttggccaacacctggccgcgccggtacgcagtagacccgcgagtccgcccgtatgtcccgaatgctctggcgaaccgcctggcccgtaacccggttgccatcgccaacaacgtgtacgcggatcgtatgggtaatggctgtgagcaggatggtgacggttggaagtatcgcgggcgcggcctgatccagctgaccgggaagtcgaactattcactgttcgccgaagcctccggcatggacgttctggagaagccggagcttctggaaactccggccggcgcgtcgatgtcttcggcctggttcttctggcgcaatcgctgcatccccatggcggagtctaacaacttctccatggtcgttaaaaccatcaatggcgccgcgccgaacgatgcgaaccacggccagctccggatcaaccgctacctgaagaccatcgccgcgatcaatcaaggctcctgacattcgcccaaagaaaaggccgcttattcagcggcctttttgctttctggctttgcctcttcaaccatcttgacctcgaccggcgcggcggactcctcctgagttaccgaatccacatagttccctagtgaactcagaacgccgattaacagcgctcttactaccttgtccttgactgtctcgcctatgatcttggtcagaacggatatcaactcttcccggagtcttgggctgattcttggccgaaagcgcttgcgatgctctttgcgtttcatgtttagtcctctgtctgcggtcttctcctcaccccgataatggcttggggatgcgctgtgttggtcggaagggtcgggcgttattataactcgacgaaaatgctcgcgcttaactgtttaacgatacgcaccgcgatattaaatcgccttctttctggccaaggaactctggcggccgggtccggtctaaggcttaatttgtcgacattaaaacgagaaaacccggatcgcctgtaggataaggcgtccgggtttatctcgatctagtgtacgctagaatcagtggcttccgccccatccgtccagccagcaatcgaagacggcgtgtcgcggcttgtccttggcgccatgagagaaatgcttgaatcggatgacctggcccttgatggactcccggtcgttccagaaacgacgtttctcgtcgtgggtcaggctggaggccgacacgttgaaggtgacgccaggccacagacgttcgttgcggcagacgaatgcgccgaccagcccggatggcgacaggttttccgcatggctggagcgagccgtgcgacccagttcattggtgaaagattcattattgttgtgcatcagctcttctacgtcgatgatctcagcttcgtcgtagtcgtagcgcttgactttcacacagtacccttccttggccgtcgagcgaccgaacttatacaggccgtctgcacgcttgcccatggaaccttcgaatcccagctcggtgtggcggcgctcgacttcggtgaactgctcgatggaagttaccagctcctgctcgaccaggtgaattctctcacagccgatgcagttgcgcaggaagttcacgcgctcggccgccctggacaggcgctcttcggtcggtgcgcgatgatcggtgaaatcgtcgaacacgtggaaggaccagtccggttcaccactgtggcggcgaagatcgccagacgatttctggaagactttcgggtcgctgatgtcgccgcacaccagctcgccgtccaagccgttgaacaatttatcactgagatattcatagatcgactggttagtctgccgctttaggcttcgagtcaaagcctccccttcgaatgtgaaacagcgaaatccatcgatcttcggtgagaaatacatcggcatctggctttccaacagcttctggtcaaaattcgatgcgagcatgggtttcatacagttctccagaaaagaagcccggcgaaccgggctaaatggcggtaagccggctcagatggtttcgttggcatagttcagttcggccatgatcgacgcatagcgctcgtccgactccttgatgaaaacgccgtcgtacatgacgcctttgcgatccttgatggtgtcgtaggctgcagcgtagcagtcgagcatggtggtgtcgtgctcttccgtcaagtcgaacagagtcatggcggccgataccaggctcttgatggccaacccatgatttccacgtgccagagcgcctgccagatcgccgaggcgctgcaaatcgtcgccgtaggtgggatgtacttcgccgctctcgatgaaggccgacagatgatcgaacagattttcgccgagttgcgcggccatgatcgtggcaaccaccattacgtcgccgatgccatctttcacatcgaccgggttgttctgaacccaggcttcgcatacttctgcgaactcttcgaccaacttcaggaattgatctttcgcagacgagcctttgatcaggttacggtcggaagcccatttaaccaccaggtcgtgaagttcgcggctcatgatttgttcgatgttcattctttcgattccttctgtatttgggatttgactgcgttgattatggacgccgtgctctggcgcgatccatccttggtggtgccgaagtagaaggccattaccgacttcagctcggcgaaccaatagccgatgatggtgccgatggcgaccgaggatgtcgggtccatcagagcctcgcggccgaatgtgaagattgcgatgatgatgagaatggagcctgtcagaagagcgaatgtgatcgccgggcgaacgaaatcgttctgctgcgccgcaagcctcctcgcagaatccctgtcggccgcctctgcggcgaactggctaagctcggcctggagctggttctgctcagactgaaggcgattttgttcggcttgaatcgcaagctcctggagacgaacgcgctcggcgctctggagttcggcgagacgcgctagagcttccggattcgcgtctagagcgctagcgaccgaggctgggtcggccttcgaccccagcgccgtcgcgacgatagcgccaacggcggcgcctgcaggcccacccaggagcgaccccagagccggggcagccgcgccgatcttactacctatgtctttccagtccatttcgactcctcaaaagaaaggcgccattacagcgcctttctccggccggtgatttagaactcttcggcttcggtcgcatcgccgacgccaccggcgtcactgcgaggctgttcctgcttgctgtagtccaccttcacctcgccgccgacgaacgacttgtacaggtcggccgcagccttgaagtgatccgggttcttcaccaggccttccagctcgaactggacgccggaccagctacccttgtcgttcgacatgcctacggtggtcatacggaccaggttggcgaaagtcggcggggtgcgcaggccctgcggggtctgaacctttttctgggacagcgcggtcatgagcttcttcgaggccttgatctgcgaagacgacagggagatcagagcctggccgaaatcgccggtgtccggatcgatgacgatgacgtaatgaccacgggtgtcggcgaagtagtcagacttcttgtcgctgaccgaaccgtcttcgttcggcgcgtacaggcgtccttcgacttccttcaccttggtcgggtctttcatcatttccttgaagtcttcgacgctgatggcgcccttgaaaccgccctcggcctcgcgaccggcccagcggatgaactcgcggcggtacgcggccggaatgatcagcaggccggtcttgccgtcgtaaatcttgccggtgacggtgttcaggaacatgccggccttcgcgccttcgatgtacttcgggtcatcttcatcgacctggggagacatcttctgcagaacctggatgaaggggattgcataggactcggcatcggcgccttcgaagcctgcgccgtcatacgatcccaaatccatgaagtcgggaacttcggtagttgcgacggcgccgccgccaccggtggcaactgctacggccttggtttcttcggttgcttcggaagtttcggttttcttaccagccatgttaggctccttgtttgtcgaatttcagttatcgctaactgtgggtttataataacggaagttgcaactaagtaaagcaaattacatattaagatttgctctttttcaccttcggtttcgtgattttggcctctttgtattcgtgcacgccgatgaaatctggcagctcttcgcccttctccaaatactcgcgaccgaacgcctggagggtctggtagtggacatcgcggttgatggtggcgtcatagccggcctcaatgatagcctcggccgccttcttcgcatcttccatttcgccgcgaccgaattcggccagaacctcggtcttgatgatgccgtcgttgtcggtttcttccagccacttccagaacttcgatttgttctcttctttgacggaaatgatggccttcggctcgactttgaccgtgcgaccgtcagccagagtagtggtcttttgaccaagctcctccagcagctccggaatggtgttgcgcttgagggttttcagctcctcttccttttcggccagcgccttttgaagatcgaggatttcgacgtccagctgcgaagccttgtccaccaggttcagcagtcgatggccgatgtcggtggcttcaaccgccatttcatccatgacgccaaaatagtcgatttcgcccggcgcgttctctttcaagtattccgggatttcaagctcttgctctttcatgtccgcctccaacttagtgatgttcccttacttgaaccaagtattgagtagatattatgccgcatcttccttgatacggctactgatttacatattaaatttcgtcgcgagtgctaacgtcagcctcaaacacgccatcaacgacataacttgccaggttgcgtttccactccaagctgacctggattttctcgtcgatggaatccagacagatcaggtcgaagtacagaaccgagttgacggtgccgattcgatgatttcggtcttcggactgcatccgcagctcgttgtcttcgtcggtcgtgtagtagatggccacgtctgcggctgtgagcgtgatcccgatccctgctgcggccgggttgcccaggaacacctggacgcgcttggcctggaaatcgtcgatcaatttttcccgctcggcctctttggtctcgccgtagtaggtgccaaacgaaatcccttgggcctccaaatacgccttgatctggtcgatttcctgaatgcgcatggcccagacgatgatggaacgctccgggtcttcctccagcagaccctccagaagatcagtaaacacggcgaatcgcgggttgtcttcgggcggcaggatcaccggctcaccatagacgttgatatagccggacgcaacttgcttgagcttcgaacgcgctgccgcagcatcgaaagatacatccagcatgaaatcttcgttctggagaacgaagtgatagtcttcttccacgcgctggtaaacctttcgttgctcaggcgacatttcgaagtatatgcgcttgtacactttgtccggcaggaatgggagtgcttctttcttcgttacacggaaactgtgcggctcgatcagggaccgcagcttgtccaggttccggaataccgggcgcccacactcgtctttttcgaccagttgcggcggcatggtttgcttcccttccagcttgcgcatgatagcgatcattcgaggatcgtcactgggcaccaagacggaaaattcggccacaaacgcccgataggatttagtccccagaattccattccgcaagaattggaactgcatgaacaaatcggtcggtgcccgcgtcagaggagttccggaaaggatgcgacgggccacggccttctcgcccagctttacgatctttttcgcacgcttggcttgtgggtttttgatcctcgttgactcgtccacaattgcgcaaactttgaatgtatcaaggaatcgctcgacctcatcatagccagcctggtggttgattgcgtcaacgttgatggcgaagacgcgaagaactttttcatctgcgaacgtctcggaatacagacggtccaagcgcgccctggcctttttggaagtcggtcggccgcgccaatccacgctcaaagtcttgatcgcgacgtgggtgggaatctcgcgcagaatccagttggtgtggacgcctttgggggcgacgatgagcagcgcgtccacgcgcccctgtaggaagaggcgaacggcatcggccaaagtcgtccaagtcttcccggtgccctgctccatcaggtatgcgaagttccgtttgttcagggacgctgccagggcattgaattggtgctgcatggcctcggtcttcatgcccttgacgggatatgttttggctttcatttgttctccaaatcggcgaggaactgaacaatgttatccagtccttctgcatagctcgcaacttccaccaagtcgcggctgttaagctcgaacaaatcgagcataggattcagcagcagccaatcggttccgatcttggccaggacgaagccccggccaccccagccgatccgctcccgaagaaaagggatttgcccaggttcgaaacatctggccattgggcaggtggaagcgcgtttcggccactcctccaaagccttgaactcgacccagaactggacacctcgacgattcaggcagatcgaatcggacatgccagaccgccgcgtctccagaaagtcgatcaggattcggccgagcgagcgctgcttaaacgcattcgccgctttcgtttcgcgatcattcatcaccttcgccctctttggaaactttctctgcttgcgctgccagctttgctttttcgcgttcggtcaaaatccgcttgacggccttcacgatgaacatatcgattccgctgagcttccagcctttgatgaggaaccaagaacctgtcggcgtcccttcagcaatctgctttccgtattgcagatatttttcaggccgaattctgaaacgtatcggctgatcaaccgagtcatcaacgcacatgatgtcgagaaactgcgactggcccttgtacaccgggtttttcccttgatcggccctcttcttctggcgaatcggttcgttctcatcagacagaacttttttcaccatcttgacaatgaccagaccatcatctccatcgcggatatcccgaatgttccgaatggggtttccggaagttactccaaccagctccggattgtcataagcatgaccccagagcgtgtgagcttcgttcaaatctgcgaattgaacttcagaattcgacagactcgcggcgactttctcccaatcctgaagcgtcttcaggtgggtgcctgccagctctttatattgagccttcagccccttaagatcggccttcaactccttcagatcggccttcaacagtttctccagttctttgtcttggctgattttcgccgaaagaatctgggcttccagagctgctacatcagcagccttgtcctcaacatcctgtgccgatatcgggcaattggccagggcgatcctcgcggccttgacgtcatcacgaaggcgcaggaacttctctgccttcgccgggccaaagcctttggcgttcatgatgccgccgatcaagcgtccatccgccactacccagttaagttcggaatgctccgggtccagggccgtatattctacgccttccttggccaattcgcgaaggatggacacagtttgctggtcgtctttcgccgcccgaagacacgcggccgcgtattccaggcgatgatatcgcttcatgtagcaggtccagtacgtcaccacagcgtagctgaccgagtgggagcggttgaatccccaggcgccgaaagtcaccatttcctgccacacacggtgagcatcgtctggggcgacgcctatggtcttggcgccctcgatgaacaattcccggcgcttgttgaagaattcttcgccctttcgcgcagacatggctttccgaatcgccgacgtttgttcccagtcgaactgcccaatgtccttcacaatggacatgatctgttcttggtacaggaaaactccatatgttccagacagatactgctcgacctgcgggatggtataggtcacaggctcgcgaccggccacgcgctcgatgtatttggtggccatgcccgaagacaacgggcctggacgggcgagcgccgttatgtggtcgatgttttcgaacgcggtgatattgatcgcattggcgaccgagcggacggcctggccttcgaactggaagatgccggacatcttgtcttcgttgagaatgtccagaaccgccttgtcgttcaacggcaagtcgtacagctcttgcgccgtcacgcaattagcatcttggatgacgcccagagttcgaagcccgagcgcatcgatcttgagaagattcagatattctgaatcgggcttgtcgagctgcgcgacaccttcagaagttaccgtacagaagtcgataacttcatcgttgcagaccaggatgcctgccgcgtgtacgccagagtgggatgggtgaatttcgaggtcgcccatgcaggcggacgcgatctcatacttttcgcggaagtcgcggccgggctgagttttctcgaaagtatcctccaatccttttccatatcgttcgtccgccgacgtatattcaatgatcgagtttttgatgttgtctgtatcgtggaaggggatgccgaagcgctttccgacgtgagcgataaccgacgcggccttgagcgtgttgatgttgcccaacttcaccacgttccaagtgccatacttctgctggagatattcgaacactagatagcgatgggtatcggcgaagtcgatatctatatcgggaagatcggaccgggaaatgtcgataaagcgctggaagagaaggcgatgagggagcgggtcaacctcggtaatgccaaggagatagcagaccaaagagccggccgaagagccgcgagctgggccgaccagcatatgcttcttggcgaacgcgaccagatctgccacgaccaggaagtagctgtcgaaatctttcagctgaatctgcttgatctcttcttggaatcgatcctcatactccttggtccattccttgatgtggccgcgactgagacggtaggcttgcccctcgcgagccagcgcgacgatatccccatccaggtggatcataggcgccttcgccagtttcacatccgccaattgttcgactaccgcacgagtattggcggcggcggcatcgaactcttcgcgagtcatgatgtggcgtaaacggctccacaactcctcttcggtggcgatgtggcgaaggccgaccgattcccgcaccttccaggccgacgcgaaatcagcatggtcgatggacggcatgtcgttgtaagaggtaattaccaccggctttccgaatgccctggccgtctccatagcgccgtgcgcggcgaccatcgacgcgggattgatgtcaatgtagtcgattccggccagatccagatgggcataggcctcgccagcgaatttgatgacgccgtcagcttcctggaattcttgcggagtcaatccttgattctggaccgacttggaagtcaagcggtagaacttctttgtgtccttggcgagcacccaggctttgagcttcagctctttctcgccatcgtcggcgcatttgatcgggatttccatgccgaatccgcgaggcagttctgccttggtagcggcttgttcccaacggacgtggccccatgttccatcatcgacgatggcgacgaatggggatgcgatctctttggcgcgctcgatgatctccgggaatcgaccatatgcggcgccgtaggagtaaccagagcgaacgcggagctgagggaaagacatcatgcggcctccattgcttgatacgcccgatacactcccatgcgcttgcagacttcgtggagcagccgcacgtcgtcgagcgcccggtgtttctgtacatatgggccgcagtagtgctcataaagatgttgcaaccgcatgcggtggccgaacaacggcgccgactcttccacagtacagatatcgagtgatgggaaattgacttcttccaggccgagctttccgcgagccaaatcgcaggtaagcatgaacttatcgaatggcaggttgtgggcaatattcgcgtcggctctggaaaagaagtcgcgaactttatggcgctgatcgaggaaagatgggtgcttgaccaggtcttcgttcttcaacccggtgatcttggtgatgatttcctcgataacgattccaggattgcagatgaactctacttcatccaaaatcttttcgccatcagttatcacgccggcgaattcgatgattctcggctgctttctcagactcaccctttggtggaacgggagtcctgtggtctcagtatcccatacagcgaatatcatgtttgttccctcttatgtcgaaaggccggctgctttcgcgaccggcctgaggagtataccgcgacggctgaagatttacgccttatgtccgtctttcggcgtgatgcggccggagcgcatggtggcgtgaacaaacgctgaatagttgatcgagtccaaggccgaatcggcatccttgaacccgctattcgccaggcgagtgagtttacccaccatgtgcatcacgaacagggcgagtcgatgatcatctgcggtcttcgccaccaggccgttcgggaagaggatttccatgatctttccgtacatcagatcattgcgaccataggtgctctggcgggcgcggaagacttctgctgcggcgtacagattgttgagaacatcttccgcgaaatcatctggatgggaatcatcttcgcccggccagacggattccatggcgaacggcgcggcgtcttcggtcgggtcttcggactgagccgtttcagcgagcggagacggggctttcgcaaacgcctcgtcgagggtaggggcggagtacggggcttgcgcaaacgcctcgtcgagggtaggggcggagttcggggcggccgggaacggctcgcctgccatgtcgttgggcgcgctatctgggtcgctatcggccgcgacggcgaagaacggcgcatcgcaaccttccaggttcaggatgtaggagtcgatccccaggctattgtaggcatcgatgatgtcctggcgatcatcgaacgccgcgacgatcttggtgacgccttcgattttcttcaggatgtcgagcgcgactgcccgcttgaactgaggcgccggctcggtgttaccatacggccgcatgatgagttcatactcgcgatgttcggcgatgccgagttcgcggtggagcttggccctggtctggaaaaagtggttgtcggttcggccggtgacgaagaaaatcatgaggtcggcgtcgatggcattcctgatgcgacctacagcgtgcgggttgagagtgtccttgtcgagacgagaatgatactcgtcccattgccgttccaaggcgaagctcttgcggtggctatcgtcgaatacgcagccgtccaggtcgaagatgatgatgccattctttggtttgcgttccatattcagatttccttactggttgctttctgggtgacggttttatcgatgaacgtcccatcagaagtgaggcggaaaacttcgccattctggatgaaatcgaacgattgcacgttcatcgtgatgcgaatggattcgctgccgttggtcacttcgacttgtgcgatgtcgccaactttctcgacaatgatcttcatgttacatggactttccattgacggccacagggttggcctcttgtttttccgatccccagaaatcgcggcgcagttcttcctgctcggccgagcgatccatccaggggcgatagaacttgcactggtagataggttccaacggaacatcaatcacaggaatctggccgggcttcgtctccagagcggacatgaaccggtcataggatttctgctggatttcctcttcattcatcaccttcgacccatagcgcgggaaggcgcaggagccggtggcgacgcagtgcggctgaagcaggctgtcgaacatcggatagacttccagaaccagccggcgcatttcgcggaatacttcctgatattcaccctgggtccgaacgcacaggcgaaccttcgccatgtcgctgagagtccgcagattgaacttggccgcgatcttcgtttccatgttggaagggatgatggcacgagcgtcctggagcgacgcgccggcctccagaagcttctggtagctggtttgcgcgtcggcaatggcgtcatgccacagacggttcagctcttcgcggacatggtaggtcgggtcaggctcgccatttaccgtagccggttcgtcgaattcccagcggaaggcttccggctgaacgacggcgctgatttccagagcgcgactggtttcctgctggtaagccccggtacgagtccgaacgagttgatgggtgaagttcttgctgacaccctcgatctggaaaatgaagtccacgaactcgaacggcgagcggatggtgtccagcatgtacttccagtggtcaagcttttcggcctcggtcatggtcgccgggtcttggccgcgcatgcgagtggatttcgtccccaggagaagttcccaggcgttctgggtgtaactgatcagagaaattttcatcagaaatcttccggaattggcgtgaagtggaattttttggttagagccagggccaggccttgggcttgctctttacgaaggccatactgctctatctcttccttgagcagttcgcaggcctccagacgcgactcatactcttcagcctcctgaacggatgagaaaacggttccatcagaggttcggtacacaagttcaatcgacatgatgacctcagtagcagcggatgatttcggcgcggatatctcgacggtcgaggtagtgctcacgaatcttatcgcgggcgcgctcggcctcttctcgactgccgaacgacaggttgaacgaagtgaaaggcttatcgtccagttcagcgccggtttgatacaggatgcctaccagaacgaaagacggcgcggtcttcggctgctggtcggcttgcatttcgagttcgaggaaggacataggaacctcttcaggatgatctggtgcgtaaattaatagcgctcctgctgagcagctacggtttccggctcgtagatgagcatgtcaacgatttccgggcactggcctttcacccagtcgatggccgcgaccagtgtggtggaagcggagaaagagaaagtgcggtaagactcatggatgtacggcgaccccatggaatcgcgctcggtcgtgcgcgaaatgactgctttgatattaacgatccggcccatcttcggcctccactttagcgattatatcggacaggcttaacttctcgccattcaggaaataactggcgcgaaacttcctgtcgccctctggcccgacgattctggccgttatggtgagactcccgccgccaagagcatcggtgtcccggaagaaagtcagcagcgcccgcttgagcgctgcctcgcgaggatcgacggccattaacctaccacgttccagccgtgctgagcgcaccaaaccgcaccggcccctgcaggaaggctattcagaaggaacacaggagtcaggcggccgtcctcggtcatatgtatgaagtagcgggcgccttcaccgagccattcggccttggcgatagcgcgttcgagattggccttggtggcgtaggttttggtgtggttcttgtcggtggagaaggttacttcgcgggccatttgtcgattccttttggttgaagggtttcgcgtttcgatgagggaatattacgcccacctgatccagaagtaaagcacttttgtaaattacttcacgaacatctgcttggccttctgataagacgaagaagtcatcaggcgctcgatgacgtccatgtcagaaaccagatcgtccagaaggacgtttcgccaagtcgcgaaccgacctagcgagaagatgccggcttcatgggtgagattccaaatcatggattcgcgctcatcgcgaccgagcggaatgattttacccttggtctggatggtcggctcgccgtcctgaatgagattcttcttcctgatgccgaaggccgagcagacgtcatccaggtcccaggcgctgtcccattcgatggttttgatttcgcccgcagcagtctccaccactcccttagtaatggattcgacgattagggtatcaccggtgattgacgctcgaaacgttccgacttctggaccggggaagtacaccgtttggaagacatcacaaggaatggaaagcttgtaccgacttacgacgatggaggtgccttcgccgaatgacgggtcgatacccaggtccagtcctgccgcagccagattggcgcggaatggtgctgtgctgatgatattaacgtgatcatcttgccggcgaaggaactggaagaaagaggcgtcgaaaggcctgccccagctgatgcgattcgccagcttagcgaccagctgctcatagtagtcggccggagcgatccaccgcttttcggtcgccatattccagatggaccgatccgacaggccgcccgttactttcctggagtacatgttgcagtggtcgatgcgcggctgggagatgaactcgccgtcgatgtagatagctttgtgtacagtgacttcgcggaacgggataccggtgagttggccaattactggcgagcggaatcgcaagagtgcgttgtgacgctccttgttctccggcgtcgccgcgtcgatgatttgggcttgaggaaagcgatgcgcggcgatcagtccggcgagtccagcacctacgatgatgactttctgatcaggaatcatgatgtgttccttctgagtgtacaaaacttgagaggataaaaaagggacccattttcatgagtcccttgaagagctagacgattcagtctcagaagagcggcggcttactcttcttcaccatcggaaccgtcggcgccctgatcttcaccgtcgtgctcctggccttcatcaccggccttctcgtcatcgccctggccagcttcgtcttccttcgaagcgatggcaaccagatcgacccagcccatgacttccagcttgctcagatagctgcgaaccgaggctccatacagcaggtgtgccactttctcgccaaaagcttcgatttctaccggctcaccgacggcgcagttctcgttgatgtaggcaaacaccttgccgcgaatcgaaatggcctgcggggtgccatggccgtcgccggtcgggatgaagtgggtggcgcgagggcgacgcgagccgttggacttcagttcttcacgacgggcttcggccttcgcacggcgctcttcctgctcttccttgcggcgctgcttctcggcttcgcgctcggccttcttctgctcggccaggcgcttgcgctcttcttcacgagcgactttctgagcttcctgggcggccttcttctcttcggcctttttggctcgctcggcttccttctcggccttcttctgctcgcgctcggcttccttggccttcgccttctcggcctgctcggcttccttcgccttggccttttcagcacgctcggcctccttggcggcggccttttccttcgccttctcggcgcgctctgcttccttcttctcacgctcggccttgcgcttctcttcgcgctcggctttcttctgttcggcttccttggccttggcctcggccttctcggcgcgctcgcgctctttacgttgacgctcggcggccttctcggccttgcgcagggcggctgcttgttccttggtcagctcttcgccttgggtctgttcgttctggtccatgttcttactccgggaatgtttgaaaggatggcttattggcctgtgagaggattatctctaaactaattgaagaagggaatacctttcgcctgaacttctctaaatatttttctttcgggaaagtccagactccagggaacttatttatgttagcgaagtttttaactcttacgcaaaaacaacaagtattcaattgcgcgagttatgccagtatacatcaactggctgtaaggaattgaaggcaagttttcttccaacattgcgacccgcttccattccgatccctgcgacttgtggaacgtcatcgcccagccgaagtcgaatccgccaatggccttctgtgcctccagccgcacatcttcctcaaccgaaaagctaagaggattgaacttcacccagcgctcatagttcgtgccgataatgcgaactttggcaaacagcatttcatccggctcgtcatcatcttcttggccttcggggaccggcttgaagtccagcagaattgcttgctcgccgttcatgatgccatattcgtgctggttcccggtgcacaccatcttctcgccgatttccggttgtacacccttgtagccgaggatgcggcgcgccctggcgttcaaacggcggcgagtattgttgtaggcgcaaaggatcacgccatcatcgtccaagaacgtccgcatttcgtcgtccgacatgtcgaatccggcccgtaccaggatgtcgtcatactcgcggcagggtaggcgcttgccctggcggacgaacatcgacgcccgaacgatattgccggcgttgcgctcgatttcggtcatgatggtgtcacagctgttctcatggaaaatctggacgccgcgcacaggaggaacttggccaaagtcaccaatctccagaaccggaatccggtgcgacagcaagcgctcttcatcccactcgccgatcatggacgactcgtcgagcacgaccaacttcggcttctcgtcgagcgagtctttgttggcaaacatgatttcgccgtcttcatcttcaccaatcggccgatagatgaagctgtggagggtccgggcattggtgcaacccttctcgcgaagccgcgctgctgctttcccggttggcgcgacgaagactgtccagtccatcgagcagcaaagttcggcgattatcttcgcgatggaagtcttaccagttccggcaaaaccggcgagtcgatagacctggcggcggtgcgctcgatcacaccaaccacgataccagttaacgacggaattaatagcgtcgatctgctggctattgggtcgaaagccgaatcgctcttcgatctgatcgacggtgaagttagatgctgacatatttgcgttctccaacgctaggtttaattgaatcgaggctcagtttaagcacgccgtccacagaccagccagtatcacgacgatacttgcgaccttgcggatcgacatagaagttcttcgtgcgccgcagcagaacataatgccaagcagctccaagcgcgtggacccttcctttatacgggaaagccttcgcctgctctgcggcctctttggccccagggagccagcggacggtcgaaaggaccaggaccgcacccttaatagcctgggaagcggcgcggccgtcctgtgggctatagcgatgtctatcgaagtctacccagtggtggttgccgcgccggagcttgaccgttcgggatcgcccctcgaacaccacagtgccttcgtgagttaaaatatgttccgccatcgaatgttcctttataacgtacagttatgctttacctctgcgcaggaagagtatactatcagctgactcgccaaagcgagcgaatttaatccaactttacttcggcaggaaagtggccgatactagagccgccgcctgtactgccctccaaaacagaggatacattaaatgcaagaatgcaagatttcccgcgaccaactcccggtcggtaatccgaatcccaatgtcgacaagacccgcgacccgaaccttaagcccggtttcctgcgtcgcagccgcgagctggacccggcgctggccgttcgcatccgtcgcgagctgatccacgccgaagcatccgacttggccaaggccggatgggtcaattcacagtccagcctttatggatcgaaagccttcccgcgccattccgtcgttcgcgtgaccggagttccggaagatggagctttcatcggcatgctgatcggcttcatcgagcatcgcgagcatggcgaatgggcggtcatggaagccggaacgaaagaaggcggcgccgtcattattccagtcgatcacatcatgcgagcgtcattcgccgaagccgaagagttcgccgaaaagtgggagcggaacttggggtggcgtctcctgcgccaactccgcgagtgcggcgccctggccgggactgaagacgagttcctgcggcggatcatcaatcgatacgttcgtgatcgcacgatcctcgatcaccacaaagtcggcgcggacaaaacctatactgatgcagtactcaaaagcatcggcgaaacatggccgaagattccttcggggaaattcgtcggacaccgagtcgcgcagctcctgatcggccacaagctaggtcgagcggggaccatcctgaatgaccttgtggacttcctggagaagttcgcggccgggcgcgataaagttctcaacatcgccatctgtaattgaggtgaatggcatgtataataaaccgactttgaatcaccaccatcaaaccgcattgttatatctgtataacaatcccgatcagccggccttcacaggccccaacaatcaggcgctaaatgaacttcggcagatggggtatgtaaaggcgaaaaaattcgaaaactgggcaggcaccggccatcttaggattgaatggacgctcaccaaggccgggattgagcgcgtcgaagtcgggtttctggggaagtgcgccgcttgcaagggaatcggtcagacgttgcttcaggggaagtgtactgtttgcaatggccgcggccaggggtggatcagcgaatggtcgcagaagccaatcgaagataatcctcaaattgcccctaagttcgaaaagaccgatgcgaataggcttgcagacgccattgaagaaatcggccggctggaaaaggcactggccgaatccgaaaagcgcgggagcgagctggccgcgagctattgtgacggcgtagtcggcgatgaatactgccatccttattgtcgttataaagtggaacgcgacgcagccttggccagggtcgcggagctggaagggaagttgacggactgggtgcacgaagggttccggctcaacgaggcgctagcggtcgccaaggctcaacccagcgtgccggaaatatctggcatcggtcgcgatgccgaacatcccagagctgtagtgctgtatctgcgtaacgaacccagcgatgaagatatgcgagcaattcagaactttttgcgcgccatggccgcccccgctcagcacagcgtgccgaaagcatggctcgacgttcaggcagagcgccgccggcaggtcgaggcccaggcgctaaggcaggaagtcgcagcactgcgcgcaagggcggatgttgtgccggaggtgttcgggcttgagcggtaccgcgtagaaaaaactgggaagggtttctggccatactgcgtgcgtgcgggggatggaacgcgtgaactgttcgtcggccacttgaagcagtgtcagcgggtagcgaccgaattggctacggcgtttgaagatgggaagtttatcgccgcgcccggcagctcggctcagcacagcgtgccggaggggtggaagctcgtaccgatggacccgacatcgcagatgacctatgtcggtcagtccctgcgttatgacgcggtaaacagcatcggcgagatttaccggcaaatgctcgccgtagctccctcacccatcgatccggccgcgcatcctcagccgtgccagcaaccacagacccatcctgcccgctgcgggtgcgagcggtaagtgccaagtaaggaattcatgtaatggaacagaagaaaccttcaccagtagatggagtcatcatgaccagcctcgacgttctccggaaagcacagcccgaagcccaggacgagtatgccgtgtccatgttcgcaacggcgatccgccagaaaatgcagagctcccgcgataaaggccgaggcagctggatcgactgcgacgaagatattctgatcaatggattcgccgaacatgcgctgaagggaaatgagaacaacctcttggacctggcgacgttcctgatgttcatgtgggtgcgcggcatcgacgatgcgaagattcccccggcgctcgaaaaggcgcggcagcacaagatcatggaagcatggagtcgggtccacgaagatggactaaactccgccagaaaggcgagtgctgcgcgacagttcgtggaagtgcctcgacgcaaggggcgcccggagcgacttgcatgaagcctcacgaaataagactggcacaggccgaagagttcctgcgcgaactcggccgagggattccggacgacgaacgggtaatggtcggctacgctgaagaggccacagtccaaaccgacgagaacggccgcaagctcaacgccggctggtggcctgtgccctggaaggaagggaaatacataaactcccgatccaacgcctacgcttgcatctcgtcatccatcaagacgcccaacccgaagaccggccagatgcgatactggcgcggcgaagcctctttcggccacggcctggcgttgatggtcgatgacatcggctcaggcaaagggtccaagggcgacttcgaccgcgacgagttccgcgagcgactagagccgaccgcgattgtagagacttcgccgaacaactaccagttctggtatttcttcaaagagccgatgtcccacatgctccagttcaaggcgctgctctattcgttcgtggaccaggtgctaaagaaaggcggcgacaacaccgtcaaggacgtcagccgttacggccggatgccattcggcttcaacaacaagcgcgggaaagacggcaagttcaaatatgccgacgaaaacggcaagcccgaactcgtgcgactgttcagcgccgactattccaagcgctactcgccagaagagatcgcccaggcattcggcgtccgcatcatcatgccacagatgaagaaggtagagataaaccgcgacgattggttgtatgaccaagtatggttgaaatatgccgagcacatctgcacgaaatacaagatgggagaagcggcaggcggccaggtccagcagaatatgtccggcaaataccgcatccgctgtccctggggcgacgagcacaccaacggcgatcctttcggcgcatactttcgcggaccgatacctggcgccgagcacgaatatgtgttcggatgcgggcacgatacttgccgcaaagagcatcgacggacatgggcggccttcactgatgaagtcgtcctgccgtatattgtcgaacaacttgaacgcatcaaccgccgtcacatcggcgaggagtagtaactatgcaaaatgatcctggaattctgattaccgccatcggctcattgcttctcggccttctcgtcttcttcgaaggcctgaatggatggaaaataccagtagcaaacttcctcgcgtcgcttctgtgcttcttcttcggcctttctgctttgacgttctggttcgtcgttgcgtttgacgtattttaatcgacgaacggtacagaaattttcggatggggacggaacttattagctatgccggtttaggtaggagataatagccgtccctttcgcctcaatatgtagaggcaatgttgaatccgatcatgtaaagcagaaggcggcaaccctaacatgattatcgacgaagataatatttttgatgatgacgaatcggggtccagtgagttcgatctcacacagatagaagatgctggaatggaccctttgatgaccgccgcaagtaaagcggccgacgatgcgattgcgaggaacgaggcgcaccgcgcacaaaaggcagcaagatacgccgaggcgtatgcggaaccagatttgagaaaacgagcgcggttgttgatgctcgaccaggcctttgatcttccggtcagccggctggtgaaagggccgttcgatgactttatcaccaagtacagctcgacttcagacagcaactacctcgcggtctatgatacgttgttctgtaagggcgacggaaccgtcccccacccgcacttcgacgagtttcgcggccggctggtggaccaccgaggcgtggcgttcaacaacaagaccctcgaccccattgacctgatgggcgccctcgcggctgcggccttggacgatccctcgattaagaagacgattgagacttgctgcgtgtgggcgcgtcgatatcgccgcaactctttgatcgaaacgtttgagaagaagataccggagtgggatggtgaagagcggatcgacacgctgctgatcgacttgttcaaaccgttcgacaccgagcttaaccggatggtgagtaagtatttctggctgagcttgtactgccgcatcaactaccctggaatctcagcgccgatttcgctggcgctgattggtgggcaggatgctgggaagacttacttttcaatcttgatatgtaaagagttgtcgagcgaccgaaagttatcgccggtccagcttgacctgagccgtcatgaccagacgccatttttgcgcaatatcactggcaactcggtgatcgcgaacgtcggcgaaatgtccggcttcaaaaagggcgacatggaacgcattaaagagttcctggtgcgatccgatgatactttcgatcagaagtttgaaccaggcgaaactatcagccgacaatggatcaccatcatggacggcaacggctatgatggtcttcaacgggatgagtcaggaaaccgtcgattttatccaatgttcgtggcgcaacttcccgacgaggatggcaagccgaattgggttaaaccgggcgatggaaatgaaactttccgcgttgacttcaccgacttcggccgcaaattctggcaagccatggctgagtgccgcgcctggattaaggcgaatggcgtggagggatatctcgatctagttcgggcgaccaacaacgaagtccagaaattctctatttcggaaatggagaatgcgcgtggcgtggttcgtgacgatacgattgacatgtatctgatcaatgttctgatcagttgcgagttcgaagagatcaagcctggcaggaatgccaagaatcctggatggagggctgacaccgtttccattctgaaatggttcgatattctcgccaggaagaagccgatttctcgtcaccttactccgcacctgaaggcgctgggattcatcccgaataagaacggcctggctggttggtgcttacctgtcgataaggttgcacctggatggacgaatggcatgcacacgacgttgccgccgttcaatgatgcgcttgtgtacttgctgagaaagggcgacccggacatcactgatgaggctgccatggcaaaaattcgggcagtccgggccgagcgagccaagattttgggcgaggatttctgatgtagttgcggagtgtacttggactaggccgccttcgggcggtcttttctttggtgcggcgtacattcgattccggtggcggccgagtgagattcgaaagctatctggtaattaggattggttggcgatgttgcattatggaaagttcgtggacggtggatcgaggattttgtgtggtgattggatgaattgtggaaaatcgccgattctgactggatttttggggtcggccgcgtcgagcttaccggtaatttacgaaaccggtaattagggcctagccttagtgccgcgtgggtttgaagggctttaacggatactttccggtttcggatgcagccgcaaaagtatactacagcgaaaatcgattgcacaatcctaatagaaaaaatctatcacggacgttacctatctttaaaatcaattaaattaatagtaatttggtaatttggtatactttagtatttgaaagccttgcggcactaagcctgtacacttcccgtcaagtttccgattccgctcaactcgcggcagggtcgccggaaacttccgtccttccaatccatgggcagcggcaacaccacggcggactaagcggcaagtgccaaaactcgacgaacggaaccggaaatttgggagcgcgacagaatcgctcagctggacatatttctaacattcgatttaacactcaatccaaacactcaccaccatcatctcccgccaaccgccgactcgaccctcacccaccagcagaccgcccatataacatcctataacaccacctaacactcattcaccatcaaacccacccagacctacaggccacccacaagcagcccatagacgcgatccctggccccatagtacaatcgcgccatactcagtgtcgcggcagagcaccaggggccattcgccaaccaagccaccacgacgactccagaatcgaactccagggacgcagcaccaaatgaccaaattctacagccccgacgatctagtcacgccacaggaattcgcagacccgcatttcgcggcgatcaaccaaaagcgattcgacctgtacatcgacctgcgcgtccaaggctacagctcctggcgggtcttccgagccatctggggcgaggagcatatggacggtcccgctcaggcccgcatcttcgcgatggagtccaacccgtactatcgcaagcagttcaaggccaagttgaacgcgaccaaaacgtccgacttgtggaacccaaagacggcgctccatgaactcctccagatggttcgcgacccaaccgtcaaggattccagccgtctgtcggccatcaaggagttgaacgttctggctgaaatcacgttcgtggacgagtcgggcaagacccggatcggtcgcggtttggccgatttctacgcatcagaagccgaggctcagaccgcgaccgtcgctgctgcggccgaagccaatggctatgtgccggaaggtgaagagggagatttcccgtctccgtctccggaaccgaccgaggaagaccgcgccaaccccatttagacataaaataacatcgttctaggcccgaatcggaccgaactaaggcgaaggtagcgggaagggacgaaaaacgattctagggctgttctaggaagccgaccaataacgatcagaagcgacaaagccccggactctagttcagaatccggggctttcttttgggtttcttattcgccatcttcgatgatttcgaagttgtatttgacgccttcgtgctcgaaagtcatcttgccagccgccttcagttgcatacggaatcggatgcacttcgaagaaggcagaccgaactcgatgaatgctgcgttgcaggatttgaactcgccgcgcttgcctttcacggtgaccgctactccatgacgctcggtgcgcttgcgggctacttccgggtctttccaggagttggcgatggctgccgacaggtctttggcctctttggtcttctccggcgcgttcttcgcctcttcgcgcatcttccggatttcttccagcgcttcctcttcggtgatttcttcttccggcttcaggttctcttcctcggccttctcttcttccttcttcttggaagtgcgggtcttgtaaaccttggccggggcttcctcttcctggaaggcctcttcctcggccggcagagcgttcaggatggcgaggcagcgacgctcagcggtcttgcggtcagagaagcgcttgacagtcgcatcggcgttgtgagcgttgtagaaggcgaccagttctttcatttctgcgttctggatgtcgccgaaggttttgatggagttggtcattttgcgatcctctgttttggaagatttcgtttgggcttcagtttgtcgccccgttgaaagagattatgcctaggtcgatgctgcgtgtctacatctatttcatcagattgatcacaaagccgacgaacggttgtctgatgtgaaaacaccgcagagcaggctgcggtgtttgttggcgttggggtgatgtcagaaagtcgggactgtgataggctcgatgggcggatcgccgggcctgtcgttgtccgatgcgggcgccgggctggaagggatcgcacccgaccgaagcgccagcgattccgactgtctgcttacctgcggtggcggtggagccgctggtgcctttggagggattggaggcaggtcatttcgacccttgaccatttgcagagggtctggaagatcgggaagcgcgccagcgatttcgccatacgtccgcgccggatcgtcgccgaacatttcggcggatcggttatctttgacgatctggctgatggcagtcacatcgccgcccggttctgctggatcgaagcccgtgaatggagtggtaacgcagcgcatgttcggatgggtcggcagattgttcaggacgatggagtccgcccagacatacgggtttttgtggttgccgggtccgtggctgatgatctcggcaggaatatggccgttcatggtgagccattccgccatcccttgccgagtcagcgggcttaccacgatctgaccagtggactctttggcgatggcgaacagatcaccgaattcgaatccgatgattgtgtagttggacctggactcgccgacgaaagccagagtttcgatgttgtggtggatatcttggtcttcccagatgtacagcatggttcgctcctcaataaggttgcttttggtgttcgaccagagacataccggccggaactttgaagcggacgtattcgatcatcatcgccgttcgacgccgattcgtgcccgactcgtcattgacgaatagttcgcactggtgcggaatgactcgcgtcaccaggcactcacctttcgagccgtagaacttgctgtaggctgcgacgcctcgcgtcatgttcagacggatcgtttcgcagagtcgctgcgcggccgacgcgctggacagatcggtcggactgaccgtcacccagtaatggccactttgttctttatcggacataagctgccctccaatgagaaagcctctgccgagtcgcagaggctggttgttgttagtcgcgcttcaacagaacgactttgtcatatgcgcgatacttcccgcgccagtcttcccagtagtcgccggccgggcaggtcagctccagagtgatttcgtctcgccagcattcgacggaaaggacgatggccttgttcctggctgcggaatctgctctgagtttaatcagaatctcgtcgcccgttttcagttcatcgactcttaccactttggccatgacattctcctattagaagggcgcggccagggcgatccctagccgcgccgatggattaacgtttgtgaaggatggacactgcgtccacgtcgaggatgctaatggtacggcgacggcgcggattgctgcgttcatggatgcgaatcaggttcgcagctggagcttcgtccaccacccatacgtcttccggtttctgcgtccggagcaggaccgtcacttcagtattctgggcgaggccgttgcagatgaaagtgaacttggacgagggagttctgtacatttcgagattcctttttggacttctggttcggcttctcagccggtgaagagattatgccctgattctcaccgccgagtaaagcatttgtgtaccaattctcccgtcaggtggaaccaaagtgcggtatcgcttatggctacgctaccgcgccatggcccttcttgctcgcacactgcgaaccacaggctgatttccatccttgccaggactcggccgaaagattcgaacctgcgccgactggacaggatgtcgacattcactcgtcgattgacctcataccggcgaccgttgatgacgaagaccagccgcagggtttgtccgtccagacactcccagtatctggtttcataccgaagccagtagcgcttgccagccgggcctaccatggtcatttaatcgatgctcctggccgcgccacgcggtccggtcggcgggacgggatcgaaccgacccaggatgtagtcgggccggcgcgcttcctgaggacacacggcgagaaggcgccatcctgcgtccagggcagactggagttcgtccgtgcagcagtcttccttgagcagcagacggttgacgttctggagattcggaccaggtatggccgatcctgtgagtgagttccaaccctcgattccactcaccatctccggttggttgatgtagcttacggacataccggccaaccggctcgcggccagctccagacgctccagcatgggtcgcagagcagcttccgggtcaatgtcgtcccagagaaggaccaggctgatgatggtatacggatagtccttgtccaaatcccaggccgaagcggtcagacggcccaggccgatttcattacacatcacgggaacgtcgttgctccaggtggacggctcccagttccgctcaccaggattcccgattgttacgccttccaggttccccaggagaacgtggagcttgctgacatattccgcctccaaggctttccgctcttcgtcggtctggttgtggcgatagaaggatggagggctgactttggcatggtagagtttcataactgttcctcggttttggaagatttgaaagttagagaatggtgtcgcagtatttctcgaaaggactctggcgcttcttctcgcagatcgcgcaggtgatttccaggtcgggcagctcgctgtaagtcttgccgagatacagccagcgcttgcacggactgcggccgtccgacgtgaagaagtggactttgcgagcattgccgggttgcgcccagccgcttggtgccggcttcctgctcataccatcaccacgtcaatttcgtcggcgaagaagctaaagccaactccatctgcgtagccagtgtaacgcagacgagtcgtcccatcaatgtgggcttcctcgacgccgatgacttccagggtggtatcgttgcagtacagcttgacgaacatcttgatgtcggagccaatcgccgcgaaggcgatctgcttgtacaggtcttgcttgatcatgctttacgctcctgtttgcggatgtattctgccctgacttcggcttcgaacttcgcccagagcgcgttgtctactggaccccagggaccggtctgagttccgtccaccggtgcgaacttgccaccggcgcggcgatatttggacagagttttcaggccgatgatcttctcatcttgggaatcgaattggacgatcatttgacgtacttcccgaagtagcaggtatggaggatttccaggcccttggagacagccttcagcttgatgccgaaattcttgatcgcccagtccagatcgtggtgatagaactcgatgatgttgacgatttgaccggcgctgtagtggatgacgcgaatcttaccattccagcggaaatcttcgcggctgtttacggcctcgacttcgatggtgtcgtttctgccgatggtccatttggagctagtcatgtcgcaatcctctttttggagtgtttcgcgtttcgatgaggtaactatacctaagtcacctcatcgagtaaagcactttgaacagattatttgaatttctggaagacagatccatcggacgcgtcatcgatatcgaacgccgagcgcgccaggttgatgatctctggccaggtcaaggtgaaggctttgccgtcatcacgaatgataatgggagtccgcagcggctcgcccaccagcattgtgtaggtatgtttctcgccggatgcggagccgatgcgggtgcttaaggtgagcggggattctttgtgtacggtgccgatcattgtttcgttcctcggtgatgcccggagaatcgggctcgttggattaggctttgccgcgacggattgttacgccgcattcagtagtcactcccttagcggcaggatcgcgaacaagataagcacaggcggctttgacattcagagttcgggttacgccgagtttgcaggaaagatcgttcccttcttcgtcccacagatgggcgatgcgagaggtacagcctttttctacttcggcttctacagttacggactgttcaatgttgaataccggcatcgctttctctccgaggttgttccgtttcaatgaggtgactatacctaagtcacctcattgagtaaagcattttcttcagattatctgaaaccttttgaagtcaggaactgccgccagagccagtcgatgtgttcgttgcagtaacgctcgccatcggacgacatagccagagcaccatccttgatgccgaaccgggtaacggcgagccattcgaattcgaactggagcgttcctgggcgagggatatgggacatggcgtatttctgcacggtcagtgatcctcagaaggtttcgcgtttgcgatagccgctactttctgcataccgaggcgatagaaatcggcttctttcctggctttggtaagctgctccatggcgtcgcacgccgtcttgtgctgggaattggcgttcttgatgctgccgtccaggctcttgtctaactcttcccgaagagccttctgcgatgctagctcggcctccaaatcctggattctgagttgaagctggcggttctgctcggcgaccttgtcttcgcgggctacgaagttctgcaggcggtcgacaagacgagtattttcgcgcaccagctgctgtttggcgactttggtccttcgcagttctgctcgcaatgcggacaactccagcgcatgcagatcggcgtccgattcttgcgactctgcggcctgcttattgcgcagatagtattgcccagccgcgaaggcgagcagtgctcggtctgtatccttaactgtcttggccatgaagtgggctcgatacagaggcgcgaacttgcaggcgtctgggtcccaggccagattatcggccacaggccagaatgcgcgaaagcttttcgcatcgacatgcgccttgaccgtctgcgatgcgcccgactcttcgcagatgatttccagagggacataaatggcgttcttgatgcttcggaaagaaatggtggacataacacaatcctcataagaagtcgcggccgggaccatcctggccgcgcatcgtaatcactcttcgccttcgtccgcgctcagccactcttcgaaggcgaaattcaccttcgactcgacccaatcctgcagctcatcggcgaactcgtcactgtcgatgtccatggtgattcccataacttccatgttccatagcgcggcattcagttcgaactgtaccatctgctcgccatcgacttccagcaggatgcggtctgcgacttcatagtcgtctacatcgaacagatggccgcccgccaggaggtgctgtacgaaagcttcatcgaggttggtgacttcgatctggacttgtttggtcatttctgcgatcctctgttttggagttttggagcccggttcgccgggcgcgggtcggttaggcgccagtagtgatggccaggcaaacacgcttgtattcagcgctgtttttgcggacctcgacctgcaccggcatggtgaagccgtggcgaatttccaggcggtaaagtttggagtttatgccggaaaagctgccgtacatgtactgcttgccgttcacggtgtggatcatcgttttgccctccagggctgtcagcccggcaaaccgggcgggtgattccgttacagcaggccggctttgcgctcagccttgatggtgtacacggcttcgtcaaccagccactcttcagcttccaggtatgctttggcgacttcttcagtgaccacggccaatttagcgacgctcaggattttggcttgcttagtcatgttcggcttccttttgtttgaaggtt

SEQ ID NO: 7 - DNA, 45276 bp, artificial sequence
  BP1647
atattccccagatacaccggaggataaaatagacttttggggtaacccccccccggttataggccctggatcaaagcacccttcgatacctgttggtatattactggatataggggcaataggccaggacatagcaaacagaggtaggcttagggtatacctatagaacaatcttggggatagtatcttgaggtatacctatagaacctggatcaagggaaccctatgccacttaccccttaccagcaacctacgaagggtagtcttagggtatacctatagaaccctatcataccgttcgtcgggtaaatcatgtgattatcaaagaaatatcaaaaagtacttgacaaggtatccaaaatgtagtataatagacctataggctcttaagattccttcttccttttgacttacttactaagtttgacttacttactaagaaggttagttatcctaagattatcttaagatagtcttaagaacccctttcccattccagcaaaaaccctaacaaatccgggtcttgcgactaaaaataaaaaaagatgaaaaaggggcttgacaaaatagaaaaagtgtgatataatagtattataaggttgagaaattaaccttaagaattcattgggatgtagctcagttggtagagcagggagccgataactctcaggtcgtaggttcgagccctgccatcccaaccattatggcccattaactaagcggttagagtgctcccctgtctagggagaagccgtcggttcgaatccgacatgggtcgccattaactcctcgtagctcagttggttagagtgcctgtcttggacacaggaggtcgtaggttcgagtcctaccggggtgaccatttagagagatcggagcagtgtatgtcagacgaaaaggttgtctcgattggggctgctcctctttctgctaaagaaaagctagacctctattgtgaggctctggcagatggtatgaacaaaacccaagcatatatagcagctgggttctctcctaatcatgcgcaacgcaacgtagctgcataccatcgaaagcatgccgaatacatcaacgcctttatctctgagcgcatcgggagtcatgtccccatggcgcttcgtgtggttgtagagatcgctagcaacccagaagagaaaggtgggattcgcctcaaggcggcccaggatatcctggatcgtggaggcttcggagctaagcagaaactggagcttactactaagaatgtggaagatatgtccgcagaggatctaatcagtgaagttcgacgaattctcgacgaagagccagagttggctaaagtcatttctttcccaacctcttaagtaccttgatctaatcaagcgaagagaggggttggtactaaagtggtacaaagactccctcgggaaagtaactggtggttatggccacttgcaactccctggggaagacggaccgattaccctagcacgagcagagacttggctagagaaggatagtaaggcagcctatgatgcagcccaagggcaagtatctcagctgcctttttgcactccagagctattcgatgccctcgttagcgtcaacttccagctgggtacagcgtggacgaagaagttcccaaagacgtggagccttctgaaagccggggagttcgacagagcagcttgggaggccgaggatagtgcctgggctaaacaaactccagtgcgcgtaagggacctccaacgggccctgtggcgtgcatcaacagtaggtgacaaggtggtctaatggatacccaagagcggctacggaatctagtcagggagctagctgagcggcagaagtatttccgcatgaaccagtacactccttatgggtggcaagagaagtttatcgcagcttcctcgaactgcgcccagttgctggctatgactggtaaccgctgtggtaaaacctacaccggggcctttatcatggcctgccacctcaccggtcgctaccctgagtggtggactggtagaaagtatgatcgtccagttaactgctgggcggcggggatctcaacggataccactcgggatattcttcagtcagaactactaggtgactggaagaaccctgaggctttcggaacggggatgatccccaaggaagatatcgtagagacgattcgtagggaaggtaaacccggatgtgtgcaagcagtagttgttaagcatgcctccgggggcctctcgtccctcatcttcaagtcctacgaaatgtcccaggacaagttcatgggtactgccatcgacgtcatctggctcgatgaggaatgccccaaggatatttatacccagtgtgtaacccgaacggctactactgggggtattgtatatctgacgtttaccccagagcatggtctgacggagatcgtcaaggacttcctccaggatcttaaacctggtcagttccttgtccatgcaagctgggaagacgccccacacctcagtccagaagttaaagagcagctactctcggtatactctccagcagaacgcaggatgagggccgagggtgttcctatgctcggatctggtgtagtcttccccattctggaagagaagtttgtatgtgagcctttccagatccccgatcacttccataggatcatcggtatcgacctcgggtttgaccaccctaacgctatcgcctgtgtggcctgggaccctgagaaagacaaatactacctctatgatgagagaagtgagagtggtgagacccttgggatgcacgctgatgctatctacctgaagggtggtcaccagatcccggtagttgtcccccacgatgcctttaagcacgatggagcaacctctggtcgtagattcgtagaccttcttaaagatgaccacaacctcaatgtagtgtatgagcccttcagtaacccaccgggtcctgatggtaaacacggaggtaactctgtagagttcggtgttaactggatgttgacccgtatggagaatggtgatctgaaggtgtttaatacgtgtacgaacttcctaaaagaaatgaaaatgtaccaccgaaaggacggaaagattatcgacagaaacgacgatatgatatccgctacccggtatgccctgttgatggcttcccggcatgcacgtcctggtgctgtacgaaacagtggatactacaggagtgatactgcaaagttgacccctgattggtttgggagtattgtctaatggctaagcgtcgtcgcaagattaagcctatggatgatgaacaggtacttcgtcatctagaccaacttgttaacgacgcccttgatttcaactcttcggaactttccaagcagcgttctgaggccctgaagtactacttcggagagcccttcggtaacgagcgccctgggaagtccgcgattgtatctagggacgttcaagagactgtagactggattatgccttctcttatgaaggtattcacgtcaggcggtcaagtagttaagtatgaacctcagactgccgaagatgttgaacaggcagagcaagagactgagtatgtgaactacctcttcatgcgtaagaacgaggggttcaaggtaatgttcgattggttccaagacactctgatgatgaagacaggtgttgtaaaggtctatgtagaagaggtcctgaaccctaccttcgaacgattctctggtctctctgaggaaatggtagcggatatcctggctgatccagacactgagattctagcacagagtgtggacgaggatggaacctacagtattaaaattcgcaaggacaagaagaagcgagagattaaagtcacctgtatcaagcctgagaacttcttggttgatcggttggctacctgtatcgatgatgctcgcttcctttgtcaccgagagaagtacaccgtaagcgacctccggctcctgggagttcccgaggatgtaattgatgagctaccatacgatgagtatgagttctctgatagtcagccagagaggttggtacgagacaacttcgatatgacgggtcaactccagtataactctggggatgacgctgaggctaaccgagaggtatgggcctccgagtgctacacccttctggacgtagatggggatggtatctctgagttgcgccgtatcctgtacgtgggcgactacatcatcagcaacgagccttgggattgccgtcccttcgctgacctgaatgcctatcgaattgcccataagttccacgggatgagtgtctacgataagatccgagacattcaagagatccgttcggtgctcatgcgcaacatcatggacaatatctaccggaccaaccaagggcgatctgtagtcctggatggccaggttaacctcgaagacttgctgaccaacgaggcagcgggtatcgttcgggttaaggccatgaactctatcatgcctctggagacccctcagctgtctggggaagtctacggtatgctagataggctagaggctgataggggtaagcggacaggcatcactgatcgtacccgaggcctagaccaaaacaccctacactctaaccaagcggctatgagtgttaaccagttgatgactgctgctgagcaacagattgacctgattgcccggatgtttgcagagactggtgttaagcgtttgttccaacttctgcatgaccatgccatcaagtaccagaatcaggaagaggtcttccagctacgaggaaagtgggttgctattaaccctgccaactggcgagagagatccgacctgacggttaccgttggtatcggaaacatgaacaaagaccagcagatgctccaccttatgcgtatctgggaaatggcccaggctgtagtagggggtggtggtcttggggtccttgtctctgagcagaacctttataatatccttaaggaagtcacagagaacgctgggtacaaagacccggatcgcttctggactaacccggattctcctgaagctcaacgggctaaggccatcagagagcagaaggaagcacaacctaagcctgaagatatcaaagcccaagctgatgcccaacgtgcccaatcggacgctatggctaagcaagcggaggcccagatgaagcaggtagaggctcagatccgactggctgagatcgaactgaagaagcaagaggctgtccttcagcagagagaaatggcccttaaggaagcggaactacaacttgagcgtgatcgtttcacttgggaacgggctcgtaacgaagcggagtatcatcttgaggcaactcaggctcgggctgcttatatcggagacggtaaggtacctgagactaagaagccctcgaaggcagtgaggaaataatcttgggagaacgttttggctatagtctagtgctgactgatgcggcacaacagatggtacgtgagaacgttcttcctgagcttttccgtattgtccaagaagagatcgagggagagtggaagtccacggcacctaaggattcagaatccagggaggccatctaccacgaactacatgccctcaaccgcgtacaacttcgtattcaggctatcctggattcgatcactctaaaggagtataagtaatggaccttgagaatcaaggcatggatgaattcgaggcagcggaagccttcggagatttgctaggtgatgacctcctggcccccggtgatgaaaccgtggatggtaaagtcgtaggggaagaagaggaggaagaggtagtagacgaaggtactccagaggacaccgaagaggttgagtccgaggaggaagaagagggttctgaggaagatcccgaggttgagtccgaggaagatcctgaggataaactcttcgagatcccgattggggatgaagtctacgaggttaacttcgaagagcttaagagtggctaccttcgcaatgaagagttcgtaactcgacaagctgaactagaggatcagtatgcagctaagttcgaagagcttgatgctgaacgctctaatctactggccgagcttgagcagtatgctgttaccgctatcgctggtgctaatcagtatgacaatgtaaactgggagcagcttaaggcccaggatccagagaagtatcaaacccttcgactggaagccctggaagcccgagaccgagcccaggctcttatcaaacgtcgtaacgacattaaggctatgcaagagaagcgagccgagattgtccactctgcctacgttaagcgtcagacagagctagccaagaaacttatcccggaaatgactacggatgagtcttggggtgacaagatcgtgtcctacggcaaatcgattggatactccgaggatgagatccgagggatatctgatgcccgccaactggctgtactcgatgcagcacgtaagtgggctgaatctcaggtccgtcgcaaggctgccctagagaagaaggaggagactgaactacctgccgcagttaagcctgctgctcgtagggcggaagcctcagagggttctaagcgggttaaagctgcccgcgctaatctgaggaaagaccagtcggttgaagccgctgctgctctcttctcctctctcgatattttctaatagaaggaaacgtaacttatggcaactccaactaatgccgtctcgactgtagagatcaacggtaagcgcgaagaccttatcgatatcatctacaacatcgcaccctatgacaccccgttcatgactgctatcggcaagggcgtagctaccgctatcacccacgagtggcagactgatgaactccgccagccgggtaagaacacccgagtggaaggtgaggatgcaaccatcaaggctggtagcttcaccaccatgctgaacaacttctgccaaatctcggacgagaccctgcaagtcaccggtaccgcagataaggtcaagaaggctggtcgtaagaacgaactggcgtatcagctggctaagaagtcgaaggaactgaagctggacatggaatacgccatggtcggtgcccctcaggctaagatccagcgtaacaccactactccgggtcagatggcaaacatctttgcctactacaagaccaacggttcggtaggtgctaacggtaccctgccaactggtgatggttccaacactggtaccgctggtaacctccgtcttctgaccgaagacatgctcctgaatgcctctgaggctatctggcgcaacggtggtcaggctaactcgatccagacttctagctcgatcaagaaggccatcagcaagaacatgaagggtcgtgcaactgagatcaccctggatgcctcggacaaccgcattgcgcagaccgtggacgtctacgagagtgacttcggtaagtacaccattcgtgccaaccgctggttccacgaaaacaccatgttcatctttgatccgaagatgcacgctctctgctacctgcgtccgttcttccagcacgaactggctaagaccggtgacagcgagaagcgccagctgctggttgagtacaccctgcgtgtaaacaacgagaagtccggtgctctgatccgagacgttgtagcccagaactaacccaacggggcccttcggggccctttgtttccccctaggaggtacatcatgagtatccaatcgacttatgcaattgacgaagaccttgggctctttatccgaaaggatactcaagatgttgagtcaatcctgtccgctaacgccgaagagcgccactcgggtgtcaatagcaaccgtaaggataatatgcgcaaggtagcaagtatccccttggttgtcgtagaggcactacggaatcgtcccatggctgaaggtggtcccatcgatcttaacctgattggttgtgacccagatcatgccgcaagatttacccgttggcttaatgaccgagataactatcggatgcggacctctgaggcacgggtgtaatgaatggctacgatcaacaacgtaactgatctcgctattgccgctatccagtggtctgaccgtcaggaccttacccaagaacttctgatgctgttcattgggaatactactgaccgtcttaaccgattgctacgggtgagggagaacgaacacttcgaaaccctcatggccttcggtggtggcattgagatccctgagcactttgttgctctaaggtctatcacgggtgactctcttatcggtgggcgtactcttcagtacatcacccaagatatcttcacccactatgttaactacaactaccaacctcagggtgtaacctactacactcggttgggtaacttctggcgagtattccccgttgttcctgacggtgccccgttcattgtgaactactggactgtactcccagagctaagcctcgctaacccaacgacttgggctctgacgaagtatccgcagatttatctctatggtgtccttgagcagatttatctgtacaccatggatgaagctcggtcccagttctggggtcagaaactcgaacgggctgttatggaactccagaacgaggagaatgccgctgacttcgctagcactcgactggcgatcaaagacattgaacgttaaggagcttcagatgcctatctttctaaaaaccctcgcaatcaaccttctggctaccctcttcccaaccaaggtaatcgctaagtccatcgtgactggtgctaaggccctggcggagaagactaactctaaggttgacgacgagttcgtaaaagtcctggaagacaaccttaaggagaagacggaggatgcaacttctaactgataacctgggcagcatcgtcagtgccctggtcgtatcctcggtagtgacggtaggttcctcggttgtcggtcagaatgttcatcaggctctgcttgaaagaaacatccaggccacggagaagctcacccaagcggtgagcgatctacagatttctatggcaatctttggggagcggtatgtcacccgaaaagaaatgaaagaagagataaaggaggccaagaatgggtcttgaggtcgcaacttatattaaccagttggtgcctacgaaccctaccggctctgatctgaagtcctttggggatgaccacctgcgactcattaagagtgctattaagaataccttccccaatatttctcaggctgtcactgtaacggcagcccagctaaacgcagtcgctgatacaacccagtatgttaaacctgggatggttatcatgtgggctggttcactggctcagatcccagcaggttggaagctttgtaatggtgtagggactacctctaatggtatcccagtccccaacctcattggtgcattcccctggggtatcgacggatcttctcaggctgtaggtactagaggcggtagcgctaacattgtatgggatgggttcactgaagggactgcccttaccctagcccaaatcccatcacacacccacacttggagaactaggggtgctactaccctcaccggttctgcgggtgactcgggtgctctgacgggaggctctggtaacgcagccaataccaaccttgagactggtcctgctggtcaaggtcagactcacaaccatgcagtaaagatcaacatgccgttgggtaatatcccaccgttctgttctgtgttcttcatcattaagaactgaggtatacaatggccctagagagacaagaggtcaagaaccctacggggattgtgaccgatatcgcccccgctgacctgccactggagaaatggtccttcgggaacaacgtccggtttaagaacggcaaggctcagaaggctctgggccatacgcctatctttgatacagcccaggccccaatcttggatatgtttcctttcatccggaataacattccctattggctcctgtgttctgaacaaaggttgtatctagccgacgggactacaatcatcgatgtatccccaggaccttactctgctagtataactaacaggtggtctgtagggtcgttcaacggggtaatctttgctaacgatggggttaaccctcctcatcatcttccaccgtcagaatcaacctttagggtactccctaacttcccagcgaatactacttttaagaggcttaagtcttttaagaacttcctggttggcttaaacgctacaagtaactctgtagaaatgccacagatggtctggtggagtacttcggctgatgctggtggtgtacccgcttcttgggacccaacggaccctactaaggatgctggtcagaacaccttggctgataccaatggtgctatcgtggatggtgtgaagcttcgtgactccttcatcatctacaaggaagactctgtatactccatgcggtatatcggtggattgttcatcttccagttccagcagttgtttaacgacgtaggtatcctcgggcccaactgtgcagtagagttcgatggtaaccactttgtagtaggtcacggtgatgtatatgtccacaacggtgtgcagaagcagtctgttattgatgcccaggtccgtaagttcttcttctcggatattaaccctgacaactatcaacggaccttcgtacttgcagaccacgtgaatactgaaatgtgggtatgctactcttccactaggtctgagccaggtaagcactgcgacagggctatcatctggaactggaaggaaaacacttggagtatccgagaccttcccaacgttctcagtggagcctacgggatcatcgatcctaaggtgtctaacctctgggatgacgaccccaacccctgggataccgatacttcggtctggggtgaaggctcttataacccagcaaagtccagtatgatcttctcgtctttccaggataagaagttgttcctcttcggtaataactctacattctctgggcagaacttcgtcagtacccttgagagatccgatatctatctcggggatgatcgaatgatgaagacagtgagtgccatcattccacacattactggtaacggtacttgtaacatctgggtgggtaacgctcaggtacaaggttctggtattcgatggaaaggcccttacccataccggattggtcaggactataagattgacactaaacatgtgggccggtatatagccttgaagttcgacttctcttcggagggggactggtacttcaatgggtacactattgaaatggccccgaaggcaggtatgcgatgagtcaaaagtacagcccttcgattccaccacaggaagaggaggaactgctgcccttccttaatgaagaattcgttagggttggacaaactcttaatgacctagctgacggctactggggggtctctatggagccccctaagaagctcaagccagggactgtaaagtattttgcccccggagtggtaggtccagtatccggcatctatcattacgacttggataaccaatggagactcgcaggtactaaacccaaggacctgccgggggattttatcctatttaccccacagaacaaccatcagccgatgggtacctgtgcctataggatgaacactgctaaggatgaggtatggataaccatgcttatgtccggtggtaactacactaacggggctactgtcctggatctaccccaggcgtattggcctcctgctgagttgtttatcccggcctattccagcatcatcccagcgcagagcactattacttatccacctccgtctgaccctaacgcacctccgttggatcaagtctttgatgttctcaacagggctactattcagactggggtggttaaccaagcaatgtttaagatcacagctaatggccgtgttctaatccaaggaattccccaaggagcagtcttcgggggtacattcacattccccctggtggtgactccatgattcatttgattactcgtgagaatatcgatctgcttcctaccgtagtccctgctctggcccgagccttcaacaggacggacctcggtaagttttgggacttcgaacacttggttcactccttggttaactacgaggcctatgtcttctaccaagaagagagtggctacgctggtgtaattcaagtgtcccaagcacccctgggtaacatccttcacttcttctggagtggtaagatgcctgggaatgaaaccccggtagattactcggaggtagacgacttcctcggacagttcgcccaacgagttaactgtcggtttatccaatgcgaaggtcgtcggggctggaagcctaccctagagaaactcgggtacaccgaagactccgtatccttctatcgtgaggtaactccagatgaacttcctccaatttaatgtaaagcgtctgatggggttcgatgtagaggatgccctagattctcgggcttacaagggtggtagtaagaagcaaaagaccacctctgtctctacaccctatcagcaaggtaactataatgaactactctcgggtgccagtgattggctacataacgggggctttgaccccaattacgggggcgatccgaactttgacccggtggctgaccaaaatgctctccagcttggtggcatcgaagggctgggtggtctcgggggtgcccttcagtctctcctgggtagctcaggtgttagctctctggctgattaccttggtccttacgatcccaacaaaactggcttggcgaacgccattggtgcagccaacgagcagatgcaatgggacttcgacactacggtacgtccagacctgcgagcaggggccactaatgctggtcagtatgggagttcccgagcgggtgtagcagaaggtattgctaccgctagattgctccagaatcaacagaataacgcctcccagttggctttccaagaccagcaggcttacaaccagaataggttgaataccctgggtaacctgtcggctattgctaagggcctcggctctggtaatgccatgcaggtagatgctggtagcatgcttcagaaccaggagcagcaggaaatcaacggggctctacagaagtgggcctatgagaataacgtcagcctcaacgacctcctcgcctataaggagcttatctccggcgatatggggggaaccaatgtcactacttcttcgggtggtggcggtggtggtggcctcgggtctgccctgggtgctctcggtggtgcttctctgggtgctctcttcggtggtccagctggtgcttctgttggtatgaacgcaggtggtagggtagggggccttctcttctaatggcctccctccctcagaaactgttcgctataggacagaatataggtggtgggcaggagcgggttcagttgagtcgtcaaggctcctaccgccccacccaccttggggcaatgcaatcgggagagtctagtggacaatcaaacccttttggcgcaatgggcggagcagcactcgcggctctcctcggacaaggaagtgagccttcttcagaaacagtaccaagcttttctgtcgagggggctagaggagcaagcgaacgaggcgcagcggaagttgcagcaggtatgggagcgggagtgggaatccttcctagcgcagaagaactcggtttcggacagcagccaaagtccggaatcctaagtaaactatttggaggttaatcctatggccagcatggcttatgaagggtccccaattcgccctagcatccttcgggctgctcagaatgaactggacatggcgcgaatcgcaaggaacaaactgccgctggctgtagagggttcaggaatccctgatcgtgtccgacgggctgctcaggctgccctagagaaccctgaccgttggtctcgggctgcccaagaggtggcccctgcggctgaagctactggtcgtggtgccctgggtcgtatcgcaggtatccttggtggtccagtgtctgttggcatccaagcggctgtaaccccaggagaacttggggatgcagagcgtactcgtgcagaagaaatagctcaggctagtcaggctgtggagaatatggggcctgaggttgctcaagaggcaaaccaatgggcccagggtgtaggccaacgtgcagcccagaacgccacaggaggccctacgggggctgaactcctgtcctatggggtaacccctaaccaaccctctatcgagcctgatatcgctccagaggtggcctctgcggctggtgctgctgtagcagatgaggaggaggctaatcgtcaggtcatccaacagggtgcagccgagggtcttcgtactggtgctgtaagtcgtcctgaaatggcccaggctgtagttgaagctgatgcccagagagagggtgtagagcttaaaccccaagagcttaagaaccgggtgaacgaagagttgacccagatgaggactatggataatgatgacctgtctcgttatgtatcttacgctctcattggtactggtcttctggcttcggccctagacaagactggtaaagctggggatatgttcgctgcctcttatgagcgtcaacttgatcgtaacctccaggctggtatcaaccaacagaagatggctgctgctgctgctgatcgtcagatcaaggagaaggatcttgagcgtaaggtggctaaggatgctgctgatgtacgtctcggggaaggaaacctggaggtcaagaagggcacccttgaggaaacctctcgtaagaacactggtcttctggatcggtgggctgaggaggctgctcgggggagagccaaccttgccctaacccagcgtggacaggatctggctaatcaacgggcccagctacaggctgaaacaacccgtcgtggccaggatatgtctcaagagaatgcccagcttagttctgctgtacgtctgaagactgctaagatcagcgctcaggcacgtcaagcggcagctaaggcagcccgaggtgaagctgttactactaaggacgcccttggtatcctgagtgaagtcaatggttctcaggctctgggtggtaagaagctgagtaagactgcccaacaggctattgcccagactgttcgaaatgaacttcgggctaatccgggggccaaccctgtgggtattatccagcgggaggctgctaagcttcaacctacgggtaactggtttggtgctgatctggactatcctgccccaacccgataaaaggtacttgacaaagtatccaaaatgtagtataatagacctataggctcttaagattccttcttccttttgacttacttactaagaaggttagtatcctaagatacatcttaagagcctattctctttccagcaactagaaggtgacttatggctctttctccagaactgaaggccgctattgatgcggaactggctgaggtcaagggcctcgacgtagccgctgaattggcttccttgaatgagccagaggttatcgaagaggcaccccaggaagtagctccagctacccctgagcctgccccagacctgagtgccctagtaactccggctgaccctaattctattagctctgcgattggtcgcggggttgataccatgcagtctaacatcggtggcaccattgctacctttggtgaactgactggcagtgactacctgaaagactacggcacacagatggccgaggagaatgctcaggaagcgtcacagtacggaacccctgatgttcggtctttcgctgatatccaagatatcccatccatcggttcgttcctaaagaataacattgtagaggctctcccttcgatggcccctgtacttgctggtggtgccgcaggtgctaaggctggctctgtctttggggcccctggtcgtatgggtggagcgctcattggttccttcctgagttccatgggtatcaacgtaggtgccctgagtaaccagatgaaggagctagaccccgatcaaagcaacccatggaccgcagtcctcgggggtgctggcctctcggtactagacactgcgggtgctggtgttatcgctgccccactcctcaagcacatcggtaaagatggcgcttaccagatgttggtccaatcgggactacctaagcagaccgccattgaggctgtaacccaagctggtaaacacgctgtagtctctggtgtggctgaaggtgttacctctggtgcccagcaggccctcctggacactatcgcgtatgatgccgttgggcagacccaatcccctgagcagttcatggataacctcctgactgctgcattcactggtaccgctatgggtactgccggtggtgctgtatcctcggggttggacaccctgggacgtaatcaggactcagctgggtctgccattgttgatcctaacgcccctgcggcccctcctaaggcgtctgagctagagcctaggggtacggtcaagaaggcctgggatgcccttggaaacgaagctacgtccctcctagagccactcgccaaggcctctcctatcgcccgtgagttctctgagaccttcagggctgatatgagtggtaagcgggcctctggtaagactatctttgaggaccaggaactccaggcaggtaagtggaactccgaacttgataacatctttgagggtaagtcttccaaagagattgacaagattattgctgatacatccgctggtgtcaacacccctgaggctacccgtctccgctccttgatggatgacgtaaggaatgaggctgtaaaccgtggtggaatgtccgttggtactattcccaactatatgccattcggtctatctcctgagaaggttcaatccccagagttcctgaacgacattactccatacttccagaaccgacaagctgctgaagatgctgtagctaactggctggttgaagtctcggatgatactcgtggtaacactgcccctgaggttaaccgattggttactcagaaccagcagactggggcttgggaagtagaccctcgctaccgtatccagggtgatccagatactttacgtggacggtttgcccagagtgatgcagtacctaagtatggtcaactggaagagagtcgggcctttggctccgttccccaagagatcctcaataagtattctcttaacgatactcctaagaagcgtctccaggaaatccgagattacttcgaaggggcttcccaccggattgcctttaccgaacggtttggtatcaatggggagaaggctaacgctaagattgcttctgctgtagctgaggctcaacgggctggtaagagagtcactaaggaagaagtggatcggatgtatgacctagtggatgcctacaatggtatgcacggtcgtatcaaagaccccaaccttaagaagctggcggctgttacgtcaggtgccctcgtgctctcccgactacccctcgccggcttctcgaccctaaccgagttcagcctaccattcgctaaggctggggttatgcctacccttggggctgtactcccaaccatgggtgaggtagtaaggcaagcagcccgcaggatctacagtggggttccaaagtctgagaccggtcggtttatgagtgatatgaaccacaccttggcttctgctacctctctaatggctgatcgggttggtgctgaggtgtttaactctaccatccaaaaggcgatccgtggtcagttcctcatcaacggcttgtccatcctaacccatgttaaccgaatatttgcaacagagactgctaagcgggtctatcagaacaacctgatggatctagccgcaggtctccccttcagttctgccaatggtgctctgaaggttgctcagcttcgggaaatgggggttaacatcggtagccagcaggatgccctcaagttgatctccccggctaccccatctgaagtcctgatggctaacaacgtcaagactttggccatgcgtcggtttgtagatcaggtagttctcgaccccaccttcgctgataagcctatgtggatgagcaacggaaacgttcagatgttctccctcttgaagggttacccagcagcctatggtaacaccatcctaccaatgttccgtagacgactgagcccacacttcgctggttcttggaccaacgctggtatgggtgccgcaggcgtagccttcactcttggtctgatgatgagtctggggtatctccaggatgagcttcgtcaactggctaagttcggtgggtctagccgagaggatacccgtagtccagaacaacggatgatggacgtagtgatgcaacagatgccactccaggcttctatgatctacgacatgctgacgggttaccgtcgagggactacccccgcagaggtagtcttgggtccagtagctggtgctgcaactgagggtgctatggctgttggtaaaactatcgcttcgtttggggatgacccatccgcaggtgaaatctggaagttcttgtataagcaaactccagcacgtcctttcgttgccggtatggaagcgatggaagatgctctggatctttaaggagaagtaatatggcaacttatgtagaaactgatgccgctggtcctggtggccgtgcctacgtggttgatgtgccaaaagtcttccgacgtaatgccgatggtgatctcattgagattacctcggatgccggtcgggtaaatactaacatcgttaccgctacagagttcctccctgactattatgcagttaaggagaacgcagccctggtagtagagaacgttacggcttccttcccggagaacccctcagaggccgttatcccctctgtccttgtcaacaccctcgtgggcgctcctggggaaacctcgggtggtaaccgtgaccctggccacgtgattggtctattctctgagaccatgattgaggcaccttgtggtactgccttcggtagtgaattccgggttgacccccgtcggttccacctgggtacttacgtggctattaagcacgtgattggcccggatgaccagaacggtggtaccatcggggattacattatcgagcagtttgatgacatgcgtgatcctgtgaagaacattggttctctccaacagaactaccttgacccccgccttgtgactactcaccttgggggtaacgtcgtcaacactcagcagcttacccagaacattaccctgactaagcagcagtctggctggttcttcatgtctcaggggactacggatattaccgttactcttggtccagatgtaaccccaggttgtgtattccactttgtgcaaggtgctgctggtaagatcaagttcgctgtatctccggacaaggcttggtatgctaagggtaatcagacgaaaactgatggtcaatttggggaatgcactgtccgagtgtatcctttcggtggtaccgtgggtaccttcaaatcggcagtttaattaggagttagattatggcaggttatatcgctgacaacgacggcaacagtgtattcgttattcaatcgaaggctattgctgttcgtaatgaggatgggacccttcgacaagtcattggcccgaaagactttgagccagtgaagtgggaggatattgaggggaagcctaagcttctggaggtgggtgctaaggctagtgaggctaaaccaggtaactggaagcctaaggctagcgaagtgagtggcctatatgaagccattgcggcttccatccaggataagatatctgagatccccgtggcttcctatacggatactcacgaggcactcgtggataagttcaatacactactgaacgctctccggagctaaagataaggccccttgggataacacccttggggccttttttttggttactcgacggggtggtagataggagtatcttcggatatcctgtccatgtggtcccggatgaagcaacagctatcctgtaggttctcgaagactacaggaagggactctagatacgagctgacacagtggacccccatcccctgttttctctgctcgaaattcctccaacgaaaccattgcttatactgagggaagaagaacttccccacttgcttcactcgatacttcataaggaacctgtccaagataacacttcaacgaggagtctggatatctctccaatggtcaggagtaacatcagtcagctatatcctacataaaccagcagggcaaacaaggctgccaccgcaatgtaggtccaagggaatccacccttaacttcttgatcttgacgcataacccctccagtctttatagaagacgttcgaccgttgatctacgatatccaacattgagctaaggaagagatattcttccgtaatctctcggactttatcagaagcgagctccagttcagcttggaccttcgcaagattgctctccgcctcttcaagtgctttctccagttcagcctttgtcatagtacaccaccttgtcactgctcctgagaacatactcagcgtcaatagtccaactcatggtcgggcatttgatccgaatcatcttgggggtaaacccatcgacggtaccaatggctaggtgggaggaggtgttcctgtggaccaggaaggctacgttgtcccccacctctagcttacgtcctactcggtctttcatagattaccccaagatatccggaaggtgaacgctggggatgtagaggatctccaggacttcgatggaatacatccctcgcctaagcccctcctcagcaccccctttcccaaacttcatatccagccagagttctgcggagatcggcgtcttaaacgccaacccccgttgaccgaagtcatgctcagacttaatatagtacaggtctggcaagaacttactcacaggaactcctccacactcatcagcttgaggtcatactctccatccttgtggttccggaggagggctacgcctcgccaatggtcgttaccctgaggacccttgtaggattcatcgtgggtatagaagctaccgactaccaatccgtggattcgcttcttgcctactgcctcgatgtggtacttgaatccctgctcatggccttggacgaagctgcgcttgatcttattgaggcgatgctcggcactcccgccgtatggctgaccactgttgggattgtagaagtagtgggcgaaggcgacaccttcgataacacccacgtcgaggaaatcatggacaatccaatcggacagatcaaaatgatcgtacccaataaaaccttggagagcagggttagagttttcataccgcttgatacgctcctcgtggtttccgatgaagaagtgcatttctggtcggtagatacgcttcttacaacccgcttggtgttgctgtaggcggcgaagaggatccagcagaactcgcatcgcatcattaccagcttgtatgtcagcgaggactcgacggccttcgatcttagcggtaccacggtcgtagcttgacagactgggcatgtcccaatggtccccaatatgaacaattcgcttggggcggttacgtgcgatccactccccaaggttcccgaggtgatcgatgttgacctcggatcgaacttgggtgtccgcaatgacgagagtgtcttcattatacttcttactcattagggaaggactccttgaaagtctctagagtaaaccagcggaagccattacgttcggcccattccgccatggattgctttgtgccatctttacgcttactaagccaatggcaagctgtgttagggcgctcgaagataaacacaagttcagtatctggagggagagcctccctcacccagatgtacttagatgcctccgaggcttcctggaagtaccccttgacctctaccagcaggtgcttcgtcgatccacaaggttgtgaggtcgataccttgaagtcgggcttgtacttgtgctgtatgacgtagctcaccgggtctggcttgaactgcatccagggcatcgtctcgtggacgatcttctcggtttcgctgtcgtacttcgtcccaatcaatgacttcagtttgggtctgaagaatctcccctgctttgccaatgagccctccttcttgaagcttccagataaccgagagtgtcccttcagtcaggatagaattagaccgaaccagaagccagatccaatcccccaggcacacccggaactccggatacttcagtttgatacgttggatatgagagacaaccttttcaacctgattgtcagttagtggttgagaatgatccagaagagggtctaggactcggttaagagtaatgcacttctcttctttatcaaactcataagcccttgaacggtagatttgagatttcagtccacggatacttatgggccagcatgcaatctcacacagccctacatcgaactctgctggatgggaatgagtggtcacgattaggttaatgggaaggtcaacaccaatggattcccacacatcaaacccctcaggatacccatcaggcttatccccagtcctacaccggactttcttgtggcccagcttattgtagaaccgagtgacctctacctctagggtatcgtcatcacaggggatcaaccgtgggcctaaccggctacggcgagtatcagtggggtcctccacgtatggcctacggacatagaggtcgatatccttgggtgcaaccccgttgtctgcatcccgaaggaaaccaccagcgaccttgtagtcagtaaagttaagaccctcaaggatctcaaagagtccttcacagattttctgtgcttcctcaatagaatatttcttcatcgtcatagggaatctcccaatgtttcttcagtgagcagtgatactcgttaccggactgctgaatatcaagccaagagcggtcccgaatgaggtagaggagacgaaaattctccagaaggtactctttccaattatctccgtacttctgttggtaggcgtaagcgcaagctgcgaagagatctctctcactagaaagctccccaagcaaatctgccgctgtctttggtcccgtccctgggaggcctggtatgttatccacggagtcaccaacaaggagttgcccgtagaggaatgccgtaccgttgccctcaagcttccatgatttctgcggctttttaacgccatacattctccaagaagcggagacccttccaagaccatcaacttgaaacggtcccaactccggctgggaatctccacagggccaactgtaatggtagcatcctgggacttggcggatatccttgtctctagaacacgctgtaaagttatctccctcttcagtgcctcgaatcccgagccagtcatcagcctcgataccgtggaaagtgattgctccccacttgtccttaagtctggctgacacggtttcccagtgatgaggcttttcaagaccgattcgagtacccttatattgcttgattttcgcaagctccagcctaaaatttccttggccagtaaggtagatttcacactcatctgcattcacccttttgataatttgttcgactttatcatcgacgagcttgtggacttcctcttcaggccatggcttctccacctggatatcgaagatgtgttccttcgacatagccacgtggcctagctcatacctaagaacgtcaccatcgataccagctatcatcacgatacctcttctacgacctgggattctttgagcttctcttcccagaagacacggagggcaaaggcttcacccttggctcggtactctgggtgctctaccactggattggccagtgcttcataccccttccagtcgtaatactcgctctcttgacgcttggctttgtccatagcttcctccgttaggctgtagcctgggggaagccccaggtctacatcgacgccaatcacagagtagttgctaggaacagtcttagcccttgggtccaacagaagttccattggagtcctcctcttgctgaatgacgagttccagggacgctagggcgttccacacttcgtggtatcggtggggtagcttactttgggggtccaaagcctcacccttgtgtcgctcaaggaggtgtctcccgaaggcagcgtcatatcgctggactccgttctcgacagacctccaacccccgcgactatacttgctggctccgaagttagcaacttgtgccactgcatatagagccctcgggaacgcttcgaagatgattccaacatccaccttgccgctatcaagtttagcgcccggctcacccggcttgattccattaggatcgacctctactttattattagatgcagctgtagaactgaccacccttacaccccacactctttcgaattcgattaaacagtaggggcagccccgtgggcatacccccgcctcgtgatcctccaaccccttagataggagcgtcttcgtcatcgaacacctcgtcgaatacatcctctggctcttcctcggtgaaggcaccaccgaacagcggatcgtcctcaccgtcaccaccggatacgatctcgtggagtcgtacaccgcgcagccgcagggccgtcatagtacccttgcctcgtgggcccttttgggtctcgatcaggatgccaacttcaccagtagagccaccccacgggttggggccatcatacggcttgttgtccgaggtcagaaccaccggcttcatcacggcagattttcgctcaccgtcttgcatccaatccacgtgcttcttctgcttgaccttgaacaggtactcgccgtcacgctcttggtacttgatggtacccttcagtcgggcatccttggactccatctgctgtaccagatcgtcggcctcttccttggtcggaatgcagatggttacttggtagacttcaccgtactcggtgtccggagttacgatgtaggggaagatcagcttcgctaccgggaaggtgaatcgttgggatactttcttagacatatcttaaacctctcgtagggaagaaggtattataccacaaagggggctgaaagtcaacccccggatgtatcagtgtgtgtcataccacgagcgaccagcgatggaatcactagccagaggacagttaaccccaaggagaactccagcatcccggacacagatttccatctgtccacgtagcgcaatgagatcctctgggtggcattcccactgaccttcgtcatggatatccaggactttccaagcccgaaggttcaacctccggacccgttcatctaggagcaccatggcccacttcatgacaattgcacctgccgcttgtaggagggtgttcaatgccttatggatcatcacgtcgccagactcagaacgtcgcatggttagcttccgtccgtctagcccttcgagataacccctctcggcttcctgcttaaccctctcaatcaatgcagcaaggtcagggttagcctcaaggaactgggcccggagcctagccccatctgcccttgtgcccccaataatagtcccgatcttggcatccccagcaccgtagatgaaggcgtagatgaacgtcttagcatcgtcacgggttgggagacctgcggctatctggttggcagtgtgtacatcaccctcgaccacctctttggtgtactctgggttattgatgtaggatgcaagcatccgaagctctagtccagcaccgtcatagcccacgaagaccatttgattcgctgggacgtataccttgtgctttcctacaggcttccacttacctttcttgagttcctccacaatgttagtgaagggcctaaccctttcgttctctccaatgtctcggcggaggacagtccatttccattcaccggcatcaggtgtcccctggaacaaccctcggatttctggtccaaagggagaacgagcagcggggatattaactactacacggtgcctcatacggcccgtaggtgttgcacaggggttagcactcccctctaggcgtccatcgggcctcacctgatcgacaagcccctgcaagagggaccgccggtgggcccaaaccattcgctgcatcaccagctttcccaggtctccctggacggtatccatcgactcttccgtcatcttcggagtcgtcaatacctttcgttgcctttctagctttctcttgacctctccgatcgtagtcttcccagggatgatcccctggagcttcattcggagtcgtccagatttactctgtcggagatcctcaatgtacttattcaaggactcgttaaggtcggatccacgtagcttcttgccatcagtgccgacagtaatatccttgatgttccattggtcaggaacccatccctgatccagcatccaatccttgaacttagcagtcttgccaaggtcgaagggaatgtactcgattgcagtgaatggtccagatacctcgaagtgcccaagtcgttgccataaggactggagcctttggttcggcttaccactctttaggaatggcttgctgaaggccccagcctttacaatcatcatgggcatctgggggacggcctcaaggtcaatcttgaggattcgttcggtaagcacatggatcagccacttggcccgctgagtcttgaagtggactccacgtttactctggcgactgatgatatcagctaccttgtgctcaacgaacagtgactttctccaatccacttagtcccccttaagacgctccgccagattctctacgactacctccacggcctcgtcggagataccctccaggtaggagaggtagtccacggttccgcttcggtccagtcgccattgctgctccaagaacgctacagcaacttgtttgagcaggaagtcatctacccgctccatgagaacacttttgatcttgctcatgttatcaccagtcgaaaatgaagtaggaacacccacgttcacaggcaaggtctaccaggtaccaggataggtcaaccttgcgctggatatccttgatatcactcagttcttcatcggacagattgagggtatcaccccgcttctccttaaggaattgaaactcccatttcttctcctcttgggagacaaccagggtatcccgaggatccagctgggcgcccctgtccacgtagaagtcatcgtagaggctcatatccttgtcacgaatccgggcgtttcgacgatccgagtaggaactcaggttcagatgagagcctgtgaagtagctcacccccaggaatccctctggcaggctcaggaacacccgacgcttctcccgtagggtaatgtggggactgctgaggaacttacggatgttagtcctttgtacctccatacccttatgtagggcagaagccatattacacaggtacttaccacggacatgtttggagtagcttacatggtcactcatttgtatctcctataggggtaaagcaacccccggcaccttaaggttattatatcatactttgctggatttgtcaagactatctgtggaaaactttgtcataccacttgtagaagtattgagcagaggtaatcccaatagcacctccccacccggacacgaagatgaaccatccgatatccaagtgggaggaggctaccgccttgatgtaagcaaactgagccagcgtgatacaccaagacactacgaacccagccttgatcttgtcatcccggagcagcttagagttcaatcctaggaggaatacctggaagaatgcactccagaagatgacaaggacttgtagagctattgacatgactcgcatacctcgggatctaggccacaggcactacccaaggggaagtcatcagcatcgatctcggggccaccccagctaccagagaactccttctccagggcaatttccttccgtgcctgatcctccaggctttccttcttactcgccatcgttaatctcctccacagaaacccatccacggacagccccaacctcgttggcccgtacggtcattggattggcatcggaatcacccaggaagaaccgaatgatatccagttctattcgatagaagtccgcagtgaacaccttggtgtcctggaaccccacgttaacccgatacttcttcattcttacctcccagaagctcttcgagattagccagtaccttctgggccttcaggttgtcctgcatgacctgggtacgctcagccttaagcaggctaatctcgttgtagatgcgatcagactcctccgaagactcttggatgaaggtcttcaggttcaccagaaccttatcgaaggaactgaggatgttactgatgctaagctttcgattgaacatagagagtcctcgggggcccgaaggcccctccttagttactttttcttacgaatgcctttggccttacgattgcccacacgaccaccatcagcagcgttagaagactgactacggacgcggagattagaatccccgttaccgccaccatctttaacacgtttgatatgatcgacaacctcgtcggctccgagtttccttccaagacgcttttccacctttcggcgggctcggtgccgctgagcatctccagacttagaccccacgcccgtttcgccgcgtcgaatagccagttccctttcacgcttgtagttcctcactcgctttttagccaatctacagtcctccattcaacaagctcttgccaagtcatgccgagtacccggaggaggtagttgaacagtgcgtgactgaccactccatcctgaaggcaatactcaaacatttcttcggagaacttggagaagtcgttgaaatcacccttgtgacacttcaggaatctaccccaggcacccagggaatgaccctggggtcggtctggccaagtcaacctcgatgcaaccaaggtatcgtagcttcgatccggagggatgatgatcccatgaagtttctcaaggacccggttgtcgtagtctaggatgttatgcccgaccacgaactttgcatgggcgatgatgcggtagaacacgtccatttcctcgggccggaatccccggactaccccagtcggaatgtctactgcaacagcgcaccatagcctcgtgacctcattgaagagtccgtccccctcaaggtcatagatcacgtaatcaaattggggtgtcatcgtcagcaggtacctcgtcgtaactgccctcgcgctcaaccaagcgccccgtctcagggttatacttggtgaacactaggccagtgttaccgtagttcctgtccttgattacacggattcgactctcgtgcttctcttccccgtcagcctgcttgttccgctcgaagccgatcataagctgacaccaccgctgcatagctcgggaaccagtgaactggctttcctttacttcagcaccctcctcgtgggtacggttacctttgggtgggttaaggtgggagaagatgaagatccgcagtcctagctcgtcggccatccctgcgagttctgtacagatacgggctatctccgtgttcatttcagaaggactaaggtggttggtcatggcggtcatgttatccagaaggatagtcttcacatccatggctactgcccagaagcgaatacactccttgatatgatcccaatcgttctgacccttattcttccacatgaagagcttgccccggagtttacccgcagcatctttaaaggcttgctcatcccactcgatatccggtcggtggaagggcacgttggctaccttccccgcgatattcttcagtgtcatggctacctgctcctccaagaggaaggtccctacgttctccccgtgctcaatgcaattccaggcagcaatctcgtgggccaacagggtcttaccgataccagtaccaccgcctaccccgatgatttcaccatcccgctgaccataggttaggttggttaaaccttcccacgggtaactcttgccccacttggggggttccagagcctcagcgtatacctcatcgacagtaacggaacagtccggagacttcaccttgctaccgaatcggatcatctggtagacctcatccccccggttacgcataagcatgtcattagcgtccttcagaggaagctcgacaaacttacactcggggtacagggcacgtaccttttctactgatttacggccttcgtcgtccgcatcgtggcaatagatgacctcgttgaaccgctcaagtacaccagactccttaaggaacgcaatgtcccgtccagcagaaccaacacccgaggaccagctaatggatgcctgacgaagatgtttccacttctccgggagtttcgactccatgatctgggccacagacatagccgacagttcatcttcgcagatgactaaccgcaggtggcccatatccttatgccgaagggtattatacccgaatgggtctacaccgcccttggggctcccacggtagtagaaggccttgggctctaggattcggacgttaaacgctcggtactccccatcgcgagtgcgtggatagtaatgttcgataacgtcctcaccattttcttgtgatagaccaacacgtaccccgtaccgttcagcgattgacttgctgatctttcgagtatcgagggctttagttggatactcaaggacttcgttgacttcatggataatatcctcctcggatttctccttacgttctggcaccttgaaaccctcttcgaggacttcgtagtgaccacaacgattgcaacttccgaaccgagtacccttttctgtatcaacgaacaagatgaggtgatttcctgttttatccccacctttagctcggcaacccggacaagccgtatcaccgatgattttcttcacttacccctccagttgactcttgagaaccaggcttggtacagcattcacgttgcccggtagggttttatagggagttgttacgaaggtaccgtagacttcctccagttcccgaagacgatcctcgattttcttcaatcgctcccacatgaagcgaatgccaatggattcgtcacagtacccaccgtagctggtctcgggactgtccgaggcctccggaatcttggagacctcgatggagtcttggaggtgtcgctgggaagctacaagacccaggatctccttgaggagcatcttttgggcatgtagttcttggtgtccgaaggtgttcggggtgtcgcggtagacttctactgctttgtctacggtcatttcgttcattatactgctccttgtcgttttgccaggtgtgccttccagtcgccatcttggacgatatccatcgccatgtggctatcctgatggtacaccagggccttgatgcgttccccattgattcggaaatccttgagggtacgatcataccaacccggataaccctctagggcatccaggttctccagcatttcatcccccgcttcgccctcggggagttgccagatttcgcctacgatgaggtcagcacgggaggcgaaggagaggatggggaagccgccagcggagtacatcagaccccgctcgcaggatacagcattgccgatgaactcggccccttccagaaggtagtggttgtacaaacccgacaggagagtaccataaacgaaaacacgaacagccattagatagtctcctcgaagattttgttgaagcccttgacgtatgcctccagggcgctgccttcagcgtccagacctggggcggtgttgatctccaggacaaaggcccggccagtggcgtgctggaagatgatatctactgcaccgaagtccagtccagctacctggatagcctctgccgctgccgacatagcctgctcagcaccatcacggtccattgcatcgttaaccccgtagacccagccgccagctacgttacgaacgatgctttgtccttcgttggtcaccatttcattggcaacacggcggagtttgacttggagaagtactacttccccacggatcacatgggctcgaaactcggtacgcttaccgacgattccctgggtgaacagttgtgccctggtgataacatccgggatgtgggtgtgaccgtagatgtgtaccgggtagtggccctgtctacggagagcatcgattgcagcaacttctgcatcgttgacagtacacaccagatggataccacgaccgctatggccgttcagatcggtacgtgcatacatgcgaccagagatattgagtacacccaaggcatcttcccagcgctcggtccaacgaggaatcaggtggggagcattggcctcgaagtggcggaagaactccagcttgttagagcagcggtgaacaactgccgggtcgttgaggaacacaggggcaatatcccggagtcggtgagcctctgcaccaacggtaccccagttgattaccgcagtacccgcacgaccccgataggtagacccctcggagcgaaggattcgagcacccagggcgttacgaagagcgacagcaccagcagaggggcgggcacctttatagatatagaacatggcaaatctcctgtttctgttgagggtagtgaagccagcaatagcccctggaatcctaagttagatcccatgtacgcatcttaggaaccggcatgggtcggccaggggctattactaacgcactaccttactcgaagtagtcttcgaagagtcggtcgatagcttccgcaatgactaccggggccggtaccaggaattcctcgtccgggttggcatcattgagttcctgctccttgactcgacgaatcgactggatcttgtccagggtgtcacgggagaagggatacttacgggttgcgtcggtctccatctggatcactacttgacgcttcatcgttacttgggtcattttgacctcctatttattttcgattacacactcaccacagatgaactcgcactcatccaggctaccagtgaacttggcaccttcgtataccgtcagatgacgattacgctggtcatatgcggttgggatcttcccgcaagatgcacatccctgggacacgaagtcccgaaagacatgcacgttgttgaaggtgtggccttgcaccttcagggggtaggtgatgttggccggaggggtgttccccgaggtgccgccgacttgaaccctgggtttagaatgggatttcgtctccgatgagatcgttccaatcctcaacactggggtagtctcccccggagtcggccgatgctttgggtccaggcagcttaccgccagatcctcgacagtaaccttgagatcacggtcttggccgatgaagtaggcattggagatactccctcggaggacggtgtatccgtggaccttggcgacgttgatgccatgagcttcgatgagaaggttttcttcacgctcgattccagtgacagttccgtattcgctgccgtttgcgtaggcctcgatcttgacaacatcgaaggtgacgagttgccggtgcttgaaggtgctacctgctgcgtcgaggttgttgttgatccggagggtgttccttgcgtacgcatcgccagacgttccatacgacgagcccgcttggctgcctttcgttcccgcttggctgccttggcttcggctgtagtcatcgtagtccgagacaccgacgtagcgactccaccatgccgctgcttgcctttcgctttcgggaatcgggaggtccagaaacgtgaccggagtggtctggggttctgcaccctttcgcactccggcctccgtgaacgggatagttaccaggacttcggccttcagttcagctatgggagaacgcaggcggatcttagcattgggtcgctctaggaaaaccttgagcatcccaggctccgatgcccatacgatggtcccggtggtggtaaccgccatgaacagaggacgatcttcgttacggatgaagttaaggctacgttccttggagtcccaccagacaaccgcagcagcaccagagaacttctcctcgaacgtcttcttggcaccgtggttggcaatggtagcgcacagcatgttggagtccacgttgtacttatcattgccgtccagcaggtgcagtccccaggtatccacggtgccgttatgtaccatggtgatgtggtctacctggaaggggtgggcatttccatggtccgttttgtcgcccatcgtggcgtaacggttgtgacccatgtagatgcgagcccgacccttgtccaggaactccttggtttcaggatcagccaggaagtcgtaggcatctactgcccgcttgtgaattcctacctcgttcttaaccgggtcgatcttggccaaaccggtggcgtgagcaccacggataatatccacggccaggagggatttgagaagagcgatttcgttatcactcgcgttagttgtggcacagaagcctactaatccacacattgtatttctccttagtacatatctggttcgattgttacgccggtatggcgctgaaggtgctgcgggttatccatgagaagtacgaaggcatcttgaagagcctcttggtcctccagaaggtctcgtacacgcacttggtgaccaatacgacgcagagaagttaccgcagtaatcgccgtatccagtcgaacctgggtacctgggaccattgccaagttgtaccgctctgctgcaccatcgagtagtctggaggtagtagatcgagccagcagcagcctactatccaaaaccctctgacgctcacgttcctgctcccggagacgtcgctgacggttctgttcatcctccagaggatctaccccggagcgaacaaagcccatggttgccaccgcgagagtagcactggcgatccccatttcacgaccacccggagacatttcatagtccggagatacccccaggaagaacacatcacggagattcacctcggagagaacctttaggaactcttccaggggagtttctgcgtgagccatggcgaaagcctttagacacaacatacgctgcatcaggcctaccatttcctggcgagtagtcagggcgtgagcaccacggaactcgatggatccgaagttgtgggttacctggaggttcaaggccgaatacttgggccaggaggtaagacccaagaccttctcccgatcaccctcgggtgcaaggatacgacgaccgaaggtctgggacaaccagtcgttgctgaagaaggggatacagaagttactatcccggcggtacggttggcagtgatcgaagaatacatcctcgaacaccatgtaggccaggacagtccgctcgtaaaccttccagttcacatcccgcatatccatgtgcaggtgggtagagcagcggaaggtgggtgccggggggttctgttccatggcattcacgaaggcttccacacgattgatcgcctgttcaccagaagccggaccagagaagacgtactccatgccatcccggagagatccatcgttcttgatatcccagcccgctacctcgggccactggtccaggccctccagttcaacctcgaacccgaaggaagcaaccgcaggcagttcctcgtggtgttccggggaaatgatctggttcttacggaaccctatctgtgtgccaataactgacatagcaagtcctcctggttcttgaattgttcatctgcggacagtcggccatctaccatctgaccaaccttcacccccttccaatggactaccccatccttgatgaagaagtcccggtgggctgggtcggagatcatttcctcggcctgggtgaagattcggatcatcatttctccggtgatagcctgctggccgtggttaatgagaatattcctcgggtcaacacccttgcgctgggtacggttgttcacgaggaacgacacgtaggtatcccgctcgccactcccgaagacgtcatagtacccactggagggccgcacgctttctacctcgctgtagacagtcccaccgtagtagttactgccgtcggggcgatacacgttgccgaggagacgaaacccatcgaattgacggtcgtcaccaatggactcggtatcgtccacgtacactacccgaggctcgccgtccacccggaagaaggcataggtggaggagtagtacatgttgaagtctccggacaaccgatggcgattattcaggtcattcatatttcacccccagcgcttgaagtgcagctaccgccgcagcgccgtcgttctcgttgatgattcgctggacttcatcgccagatacgatggacttgtactcctccaggaggtgcttggaggtgtaagcctgtactgccatttcatagacccactcggtcaggtctacagagaagatccagaagttcgacaggctacggtactcgccgccgtagggcttatagcgcattgcgccagccttgccgtacagcttcttacgctgggtgtcaccgtcgaggatgacagacgccaggcccaggaggtagtcacacatctgcatgacctcgcgggtgttcgccttggtgactcgctcgatgtggctgaagccaatatggacgtggccgccagcagtgcgcagggtcggaggtgcatcgttcggcatcacgttctgacgacgagtccagcagttgtagtccggctcgcaaccgaagacgtaagcctggggaccgaagctgcggaggagttcctcgtcgtacaggtgagaggacaggttctcgatgatgttcatgccgaaggggtggagcatctgggcacccaggagtcgaacggaaacgatacgcttcacgaactcttccttggtgctggccgggtcgatgttgtactccagaagaacgttgtcttcctggacggcaccaccggctacagccaagggggcttccttggttccaccgatgaagccgatgacgctctgggggttacggtcgtagccgacgaaaacttcgggatctgcaccgatcagggggattgcgttgttcattgcatagtctccagtttttcgaggatttcggggatgctgtagggactggggggtacggtctcagacctttcccgacctgggtcacctacgtcgatagtgataggtgccatgatggagaggatccgatcattgtgtacaccttcgagcccgtcgcattcgatcaggtcatcgtccttggtatacccttgccacaactcagcgtcgtgatgcttgagcttgtccttgaactcttctcgagtccgcccatggatgctcttgatatcgaagtaggtgatctccttgtacccacctacgatatcatccatgacttcgcttatgtagctgtcgtccacctcccatccttggctttcgcagccctcccggtattcaccagcagtcaccgggaacatggcaggatagctgtcgcagtgagcagtgctacctacctgggcacaagccgcgagggtcagaagctctgcgttgaaccccaggattttatcctgagtttccttttgaagacgacgcatctgatccccgatgccacagagacgattacccatgcgaagcgcgcaaatgattgccgatgcgtttttcttgaggtccacccgaacgtacacagcctgtcggcggccaggggggctgaagtggtcaggattggagaggttttgggtagccccgtcagatcctgtccaccacttggttggccagtcctgggaagctgagaggattccaccgtcggtgatcctgttgaccagatcactgttcaagaactccaccagcttaccagcagtgttctcgtgggtatacaccaggaggtgtccaaccccggtctcccacactacatcccggataggccccgtcgagtcgcagaatgcaccgaagcagttggtatattcagccacgtatttaacgcagcagtgaccaacctcagcaccctcggcatcgtagtacacgttatgggctgcatacattcccatttgatttctccttggttgtcagaagtttttctcgatgaatccttccagggccagggggatatcccttgagccgcgactccagtgaatttcacccatggtccccagcatgaccactccgtgtttttcacagtcagagggagtaagccggaggaatcctcccagttccgtatccacggtgtcgtagggggttttcttgccgaagatggttggctgaggtattatggtaactacctccaccttgttcagcttaatccccaggtattctgacctgtagggcttggaccttacccactcacgtccacctggggcattacggttggccacccaacggccgaatcggttgcactcttctgcggactggatgtggatatcgcctttcttgatatcctcccaatcactactgaacatgtagttggtgaggggatacccggtgtatccattggctaccaatccgtggaaggacattgcgaggtaggacttccagaagccatgcttctcagcaagcttcaggtgaacctcctcttcacgaccttgagggtctaggccgctggacaccagcttgaaaaggaacttcatgatggggtaccaggaatccagggtatgttccttcgggttgaagtagataccgcaaaccccatccttcccgtgtttagtgggagagatcaactccgacccgctaacatacttcacgaacggggaggtcttggccttgctttcgtaagaccagaagtgaaccttcgggatcttgtaggccttgccgccgatggtgatggtcttgagttcaccttgggtacacttattgagtgcatcgatgaacttcttgctgcgacgggagcagatgaaggtccaaccgtcgagcttataaccatgggttaccaccccatccatggctccgaagcaggaggcagaggtcattacattgagggccttaaccccgcccttcttggatttcataccgaaggcgtacttgatacgggccatttgttttctccttgattgagttagccagcaatacccccagggagttcctaggggtattactagcgacctctaagttacttagaaggtgccacggcgctgttgcttgcctttggtcggtgccgacaccttggtggccttgaggttgccgttcagggtcaattcaccgttggagcagagacgctcgtagaaaaccttacgcttacccattgtccacccccttagcgaacgttgatgaagggcatggcttggccgccggtgacgtaggtgggcagcttgccgtcccacttctcgatggcattcagttctaccacgccggggttctggcggagggcttcaccctggattcggaggctttcggccttaccttgtgccaccaggattgccgcttgcttttcaccctcggctgccgcgatagccttggctgcctcggcctgggtctgacgcagttcgttctcacgctgcatcgccgtctgggtagccttgatcttggcattgattgcctcgaccacctgggccgggaggccgatcataccgttgaggtacaggctttcgacgatgataccacgggtggagaagtgctcacggacggcagcttcgacttccttcacgaaggcttccttgcccggaccatagatggcctcggcggacttcttgctgctggcgttgttcacggcgttacggaccacctgcggcacgttcacgcttacgatctcgttcatgcccttgcgataggtctggaacagcaggggtgcgctacccggagcagcccggagggtgacgccgatggggaagtccagcttcaggccgtccttgtcctgggcagtaaccaccgccaggtcgaagttctggttgaaggtggggaacttgaacaactcctcgttgggggtcaggaacttccagccgaccggggtttccttcaggtcaacacccttggagtcgcccatcatgttgacgacgacgccggtatagccagcgggaaccttggagcaacctgcggtaatggcgagggtagcaatggccaggaggccgaggattttcttcatagggattccttacttgtagagcagaggggtgatgtagaccatgcacaaggcaatgaacatgataaacatcagtacgtagaagccccaatcatgcgggggcttacctgggtggcccagcaggccgtctatcttatgtatgttgtcgtagaggtcgggggtatcttcgccgatgccctctaagtcctttcggattgcctcacggaggcggcctcgcatctgttccgtcatagtacatcacaccttcaccttgagcgtttcaccctcgggtatcgccacgaaatacacggggagttcccgagggtgcaggtacaggacactcccattgcagatgtttaccatcgggatggtgaggtccttccgggattccgaacgaagatatatctgagaatcgcgcttacgttcgaagtaaagggggagggttgggcccttactgattctagttaccgtggccacgatgcacctccttctttacagaaagtttacctgcgtaggagtataggtggctgacagcccagagggagtagaggatggagagtaccagaaggccggcacccatggcgttcatcagggtgttagccggggacagcatctgaggtactacccagaggatgcttatccatgcggggatagccaggagcattacccgagtgtagagcttgaggaccattgttcttacctctttcttaagatgaagaagatagaaggtagaaccttaggtaccttagggatataaagcaacccccggcaccttaaggttattataccacacttccagcagaatgtcaaggcctagatgttacagacctttacagagcttgtcgaggtactccgagtgctcgacggtacctgggtagtcctgcaacccaccgtacatacggcggagaaccccatggttgatgaggatatctgccgcagccttcacgttgatgacgtggacccggaccttggtcgagtggttgtcgctggatgcccaggggttgtagtggctgcccatgcggcggaggatggtatctgctaccacctgctcgctgttcacggtgaaaaccatcgtaccgtggccctcgttggattcacgacggatggcgccgatcagttccttggcgaaacctcgggggctgaacccgttggatgcgaggccggcgtaatggtcagcggtacccgaggggcccatgccgatgtagatttttgcggtacagcaggagggaaagtctctgcgttgcattagtaatctcctttgattagtcgtttggttgacttgatgagggctaccgacatgtaggccaggatcgctgggattatcaggaggtatgtcatcatttgctgcggaccatttgtaccgatggacgcccaagagacaccaaagattaccgagatccatcaccagtccctcgcgcagttgcagcaacgaccctctttagggccgaagactggcatacaatgggggcaagcctccccggattggatcatagcctccctggcgtgccgcaggtaagccgatcggctcgactccacacctacggctgccaaggtgaaaccaagctcaccacggggctcctgagggccttcctgatgggtcatgttgaaccctcgtttctctactcgacgcttcatgcggcgctcctgggccatgatttggccgatcattggtttattcctcatacggaccccacatcctggcggagacatgaacgtacttagccgggaagagttccccatgaccaacgatcctgtcggactcgaagatggagaagccgctgctggtgaggaccgttaccatgtcgccttgcttgaggtataccacggttccagtttcccgctggtttacatacacaccatcctctcgcttgctgatgtgcaagtcatttcgaggttgggttgccgttatggtgaaagtagtcattggtcacctcagtggacccgatgaaccttgtggtccaccggaatgccgagttcgtaaagggtttcggtgatgaactggccgaagttgatgaccttcaggtggaattcaccatcgggactggccaaccaatagacttgtggttcagtggatttcatagacgatacctgcacgtttgccgaagatcgacacacggatatgagtaacggaccagttggggtacagtttggggttaggctggtatcgacggatgacaaccttggataccaaccagaggtagatgtattgggcgggcgtcatagtacacaccctaggccggagggccgaaccgatggacttcgatggacgcggccttgatggtcacggggtagaacccgcagtcaacatcgccgctgaagtatacggcacccacgggcccaccgaagatatccacgatgaagaattcatctgcaacttccatgtacataaaaacacgcgggtttgcagccccgtcctcgtcctggcggatgtacagacgccccgactccagatcatcccaagaggcaacccggatcttactggtgagcatattgtagttgagtttcatgttacacctcgtagcaattcagctcggcagttactgggtataccaggctcaccggaggcatgtaaatgacgttgccagtcttgagattgagaacgggaacctcgtcggattcgcccttcatcttaatgctgcggagttcgcagaccatgtacacatccccaccgatgaggaaggtttgggacttaaccagagaactgagggttactccgttgcgtggccacaccttgatatccataggactacctcacgatgcaaaagggatgctgtccaaggtcgaggacaggacgaagagaaccacccacgctaccagcaacaacccattggaacgtgagcgtatggcggcacatgcaatatacttccattccatcaccgcgccctgttcttaaccaaagatgcccgcttggcacggagcttgttcaactccagggttttaccaaggtggctaccattggtattggtaagctcacgagttaccttggcgatcttgcggtcgatagcctcgatggcttgcatgttgcggctgaccttacgatagtcgttgcgtttcacgggatagtttcctttattgatttcccaagacgccccagcctgcgaccataggtccggtgggggtttcggccaggaatcaccatggcctcatcagttgggattagatacccatttcctctttccaatcacgaaagaagaagtaggcgataccaatgctggatacaatgatagcgatggtcatttgctaagtttccttatgagttcctggcgctcaacaatccaccggggatcgggatgcacccggatcatcctagtgagtttcttaagacagttaatcatctgagaacgttcatgggcggcttcgtagggtgacttcatttgacccacccgcagacgctcagacggataccatccgtagagtagacaccgcaggcaaatttaccgtccttaaaaacccagcggtaaacaatacccccttgccaacctacccttgcatcgcagaaaccagacacataaccccgatcttggatggaacgagcctgcccaaagatacagtaacccacggaaacctcctaccaggggcgcgtaatagtacacacccctggcgcacccggcgttacgctgccttcgcttcgtccttgacttccagtcgctggatcacggcgatacgctcgtccgcttcctggagctggcccttgtcgatggcacgctggatcttggccttgaaggcggcgatggcctcgtcgagggagaactcgtcggccacgtcacgctctttcttgtacttgaaccagggtttctcggctgcacgctccagtcgagtagccttgtccttggcgaagacgaacgggaattccttggccttttccttgtcggtattggccgcgatcttgccgttgtctacgaaccagtgggcaagggccagccggcgggagccttgcggcatcgcgttgaacagcttgcaggccaaggacacctcgccatgctcgtcgatgtgtttgaggatatccatgccggtggtttgaaccagcttgtccagggcagcaccccggttggcaatggttttgatgatgccgttgatacgcttgtagtcgctcataacttatacctcgggtttgatgtgggttacaggggagttcttgcacttgctaggcttgtaccaattgcgcagcttagtatcctcacgattacgccaatcggtattcatcagagcctttcgattgcgtgccccagccttttcctgaagtgaaacatacttactgtccaggatcttgttacaattggaaatgatcccgaacttctgttctgcccgctgctgagccttgccaaggtgcccaatgttaataccttgagcacgagccttacgactagccttgcggcgcagcttcttatcgatagcagcgttcatcgtttcatccttttggaatcatcagccgggacacacatcccgatacgacaaaggggtttataggcaaaccttggcattggcgtagcctgcccctttccgcgttagtatcgctgttatgatctgtcctctggctatcttcgggagtcttcgtgtctactcgtccctaccttcgccagtatctaccaagcttcgccctctgcgctaagccaacgatactaacccaacatactgtccatcacgattccaccatggactctgctaattgtttacgctggagcaggcaaccagtcggatgggtcataaggcagcgaccatcaaagccagcgctctaatcggagtatgcgctattccctcagctttcgggtttctcccctgttcagtccaaggaccgtcgaaggtacactttccccaggtggccgtcacctgatgggtgcccatgttagagccgtgggcttggcttgttaatatcgcgctttatagtctctcgacttgttactcagtggtccgtctgtatttacgtggtggaccaatcctatcggctggagtcacagctttgtagttaggctataaacaaggcgccctatctacaccgccccggatcaaaacatccgcttaactggggggccatcctaccgcttcccctatccacttgtcaacccccgatgcctgccggccttacacttgggtgacttgtgcgctcttccttggttggcagcccccggatagcactgcggcaagggggatggtggcctaggtagaacgtgggggccattaggcccggttccgcggggtttgtcaagcccctggggtttcccccgatgcctatcggtttccctctaggcggcgccattacgccatattctttacggggttgtctactggttttttatacagcctacaggctagtagtcccccagcaaacccccggatatgaacagtctttgactaacatagggtatcaacggaagtcaataggggatcaaggggttatcaatggatattccccccgatccaccccctgaataccctaagatttttcttatgaatacccttgggtccacccgatgaacggtatccctaggggttgatcttggggttagtctcatggtatcctagggaggggctaggggctatacccctggggataggccacccccactttatctgggggactcctgggggg

SEQ ID NO: 8 - DNA, 65652 bp, artificial sequence
  BP1648
  misc_feature (51714)..(51714): n is a, c, g, or t
gttcgtttcgatgaagagattatgccgttggtcagaatggaagtaaagtgtattaacaataaaattatgttcaccgacgaacggttgtgctcgaccgtctgttgcggcgtcgatatactcgacctattgctgacaccggattgattagaatgtacaaactcaaccctgcactgcgagcggtctggcgaactcgcgcccgttacaaagtcatttatggcggccgggcgtcttcgaagtcacacgacgcaggcggtatcgccgtttacctcgcggccaactatagactcaagttcctctgtgctcgccagtttcagaaccgcatcagcgaatcggtctacacgttgatcaaggacaagattgagaattctgagtacaacggcgagttcattttcacgaagaactcgatcaagcacaagatgaccggatcagaattcctattctatgggatcgcccgtaacctgtcggaaatcaagtctaccgaaggcatcgacattctctggcttgaggaagctcactacctgacccaggagcagtgggaagtcatcgagccgaccatccggaaagagaactcagaaatctggatcatcttcaatccgaacgaagtgacagacttcgtgtatcagaacttcgtggtgaagccacccaaagacgccttcgtcaagatgatcaactggaacgaaaatccgtttctcagtgagacgatgctcaaggtcatccacgaagcttatgagcgcgacaaggaccaggccgagcacatttatggcgggattccgaagactggtggcgacaaatccgtcatcaatctcaagttcattcttgcggccatcgacgcccacaagaaactcggctgggagccggccggatcgaagcgcatcggcttcgacgttgcggacgacggcgaggatgcgaacgcaactacgctcatgcacggcaacgtcattatggaagtggacgaatgggacggcctggaagatgaactgctcaagtcgtccagccgcgtttacaacctggcgaagatgaaaggcgcctcggtcacttatgactccatcggtgtcggcgctcacgtcggatcgaagttcgccgagttgaacgatgccagtcccgacttcaaactgatctatgatccattcaacgcgggcggcgctgtcgataagcctgatgatatctacatgaagctgccgcacacgacgatcaagaacaaagaccacttcagcaacatcaaggcgcagaagtgggaagaagtcgcgacccgattccggaagacttatgaagcggttgagcatggaaaggtttatcccttcgacgaattgatttcgatcaactctgaaacgattcacccggacaaactaaatcaactgtgtatcgaactttcgtcgccgcgcaaagacctggacatgaacggccggttcaaagtcgagtccaagaaggatatgcgcgagaaacgcaagatcaagtcgccgaacatcgctgactcggtgattatgtcggccattctgccgatccggaagcccaaaggtttcttcgacttctaaacacagaaaagcccggatcgctccgggcttcgggtcttactcggtgtggttcctggcgctgagtgtcgacgcaacggcctcgccgactcccagggcttcctggccggccgcgagcgcttcggcttccgactcgacgatgaaatcatcaccttggccatcgcctggcggaacctcgaccagcacggcttcttcgccttcgaaccgcaggtcataggtcttttcgacggacagaccgtaacgagcgttgagcgcgtcccagagctgggcctcataggtccgcaggtcttgcagagctttctggtggctgagcatggccatgtcaacggcccgttgcagggtttcgtccaggacgttgaaccgaatgcgaagagaacgaatccgctcgacgacttccgcatccactacatgtctttcgatcattacttttcacctttgctgaatgtaacgttgtagccgttgtcggccaggtaggtcagggcgccttcgaaggaagttccgacgaggtgctttagcttcatttcgcgttgcgcggccagccagaatgcagttccggagaactcggcgcggccttcggccaagaccctgccatcaggcccggcgatccgtacatgcacggaagatagcttgatcggcatcagtgaatacctccactggcttgcgacggcatgctttcggcgcgtgcggcttcgcagtccgggcagggacatgcctggcggacgcgctccagctcgtcggcatccatgacatagagcttcccatcggcagtgtcgtgcgccatggcgatgttcgggaagtcggtggcgctcaggccggcgacagcgcggatttcgtcccaaagcaccagatgctcggcattcagtcgggcggcgagcgcttcgtgctctttagcgacgcgcgccatgaactcgtccatccggaatgcgaattccgcatcgatggcacgggccgaggccatggagctgagtcgaatcggttctttcttcatgatgattctcttttggttggcggttgttcgctgctcaggcctattacagtctgagcagcatgatgaagatgaacgcaaggaacgcaaacggcacaagtatgccggacatcagctttgacaggcgctgcatctcagcgtatttctcggttgacattccgtgctgcgccgcctcagctgcgaagcgggctttcgcctcgataacttccgggcgtagcgacaggacatattctaaggcctcttcccgcgctttttcggcctcgaccgacctagggtcgcgggcagagacttcgctgtgccctggcctcgcgggatgggcttgcagagatggaggaagttcagcagccacgactccatagtcggcgcaggcccaagcgatcccgatgatgatcgcgaggatggattggacgattcgcagcatcactttgtcgctagggaagttcataatcaatcctccaccgaccgaacgatttccatattgcgcccggcattggcccctgcattgaaggcgcgccgaccgtcgctatcgtccagacgcatgagcttcgtaacattggacttcttgtagccaggatcgccgaaatgttcgtgaaccgcagcttccttcaccacaaccagagacgttccggcagaagataccagctccatacgcttcctggttatggactgaaggcgatagctgatttcctgggtcgcggccagtttgaattgcgcggcaacctttacgttgaaacgttcgtacccttgcgccttctgatactcccgacacagacgatcaatggcctcgaccagggagttgaacatgttcaccgccagctcaacgtccgacttgtagcctttgaagcgtacggcatgaccccagcgcttggtagtgcttccgtcgcgggcgctcctggatgccttagccgatgctctgtggttgttgatgccaccggcgaaatccatgatgcagtcattgtacgtcgccacggccactgagaaaaacttcatccagttcgggattgcggaatagtaacgagtggcaatttgctcatcgaactcttcgcgaatctcgccggtagcttcgaagtcgtgaaggtcatatttgtccttcaacttcttcacacgctcggctgcgatggccgcttcgtgcggactggaagagtcggctgccatggcggtcagtttgcggatgcggtctttcgccttctcgatggcttcaggggtgaattcgttctggtcggtcatggtcggttccttttgtctgaagggttcgcatttcaatggagctattctgccttcattcagaatggaagtaaagcactttcttccactatttcggcatcgactggaagaaattccagatccaatcacctgctaccagcaagaggatgagggcggcaaagaacaagacagcggccgcgagctgtgcgcccggcttcagtttgggatggctgagcttgggctctacgggaacggccggagcgctagcgctgcaaccggcgtctcctgggccgtagccgatgccgcgttcacacgcctggagcgacaccagggatttaagatactcggtctgcttttgcgactcttcgtagatgccggcgacggcgaaccagagggcgaacactacggacgtacacacaacccaggcgccggtcagcaggagggccagcgggccgatgacgaagacggtagcagccaggacgattgcgccgccccagatgatgaagccggccagaccattagtgatgtcgacacagaactttttcattttcagattccttcggttacgggatggaggggatttgaaactctgcgccgccgagaacatcaatgacgacttcccagagcgtcggaacagaccactggtaacggtcgaagtcggtttcaggatcgacgcccagcgtcacataggaagtggcaggccatttatgaacactgcctttccgcatgagagtcgccacgcggccgtcaccgagcggattcgtcctgtgcggaacgtacgcagacatcgaatattgctgcccggcgtcgataacaaatctttgcctctggcgcagacatacagagcccacaggattccagccgcgaccgccgcaagcctggcgagccgaagaatgctcataaccttcgtgagtcatttcgccgaggcaagccgagcgatcctcgtaatagttgatgttctccatcgatccaaccagcaccagagactcgaaatcgaatcgatgatcgtggatggccgagtgattgaagcaaagccgacgcggcagctccgggtgccaaacatggaggcgaccggccggaagttggacctgaatgaaccccaggccgtgcagagtgatcttgtccttcatcgggtcatggacggtgctcatggataatcctcagtagcagaaatgtattgtgagagttacgattgataagccggtcgcccatagaagggcgaaccaggccatggctttgatggtcgtgtagatcatccgaagaattttccggcacagatcgggccaatgcccatttcgatggatgcgtggttggtcaactcgcgaccgcagcaggagcactgaccagtcttccgaccgtaggcgactgccgattccatcggcttttcgaacatcttcagaacgtcgtcgtgctcagtatcggtgcagtcgcgactcttgatgaatttgccattggtgatccggccgaggtagatgtcgcccaggacgtacaggctaccggcgttccggctgtgagcgctagcctctttcacaacaacgatgagcggctcctcgccttcgccagctaggcggattttcgggcgcttgataccagactctttcgccttctcaaacgctttctcgatgccggaaatgtccagagtcggcgcagcagcttcctgcgcggccactttctcgcgatacttggcgaggttttcgatggcgcgcttcgcagcagcgatctgattttctgtcaaggagccgtatttatacaacgactcctgaaggctctgagcgaagctgaaggaatttccagtccaccactcgatgatgtccgggtgcgcggcttcgaaggccttaattttgaggtcgcgctcttgcgcagcgctacagattttctcgatgcgcttttctaccgccttagcacggctcttggcgcgctgctccgggctggttttatactctttgtatccgacgccgcaggcaaagcaggcgcgaccataagacgaagggccacggtacaggccggtgcctgcgcatttggtgcacttgtcgcgatacagcttcacttccttccgggagttcgggcgggcacccatggacacgtcttccagggtcttcggcgcttcgttgttgatctctacggtagcgaagtcatcacccaggtcttcgaagccggtgaacagattctttgctgcgttcatgtcgattctcctgtttggaaagttcgtttcgatgagttgactatacgccagaaatggaaaacggtagcgatttctcactaccgttcgtcgggtcgaagacaatcaataaatgtcgctattgatcttgaacccatgctcagcgccgtcgttgtagtcgtactcagcatagctgtcgcagtagtcgttcaaatgctgaatgatgcctagaacgtcgttcgcggccttgtgccgtttcgcggcgatggtcttggcgatgctgtcgccgacttccagggtttcggccgtccggcgatggatcagcagacggctccaaagatagagccggacgcgacgaatgatgtctcgatggcgctccagtcgtccgtgcaactcttcaatttcttgctcgcgagatttcactactcgtcgaagctgctgaacttccagttccaaatcggccttagtagccatgttcacctcaaaaaggaaaatcgtctgggactccaggaagttcgacgattattgttgagcctgatcgatccagaatgcatccgaccgagccagccctgtggggatagggtctacacgaactataacaggtaacttccatgactattcgccaggtcgatcctccacaccatctacagactggtgggcgcttcgacttcagttttcgttcgtccaagacggcgcgtctgtcgcatgaaaggcagcgcgccttaaccgacgtaaccatgggtatagtcgatcattcggatgagaccatcatcctctgattccctcgacttcagaccgcccaaagagtccgactggccgttgcatttcgcatcgatatccatcgaagacaggaatcctgccgatactgcggtgatatcaactttgtcgccggccttcttgaagtcttcgcactcagcatcgagggccacaattgcactcgcggccatgttcacatgactgatgaggtcggggaagatcacaggaacttcacgcgacatgccacggaccgtcagcttcaggactacatacttcatactcactatcccttttgtatgtgaggaaagaacttgctgttttccggatggtgaaaacgctcggtcgcaggcggtctttcttccggacattgaatcgtcgaaggcgggaaaaccgcgccggcgataatcgccgcgaggagtgcagcggatgtcgacatccagagggcggtttccaggctcacccgaacttccggacggcgcggcttcattcgctccaccctcttcctggctcataggatggtagactgccgccgcgaacccagttgtcccacatatggttcagaccagtcggtggctggggcggcggactgtagaatccgggcgtctcagtgctgctcaggaaataaggcgtgcaaacggcctggacgaccaattggtgccgctcccacatcttatcaatcgctcttagcatgacgtcttcgcactgagccttactgtcgaaccgtctgctagtatggtccggcatctggacacagccgtctccagtgcaaaggaaagcagtagcaatccatacggtgatactcgccatttcgtcaccctctttagttgatgagcagagtctattccatctgctcgccaggagtaaagcgcttttcgtcgggataaatgccgatgatgtctgcgtcgagcatccaaatgtccacggacggatcgtcgctgctgatttgatataggttgtacagctcccgtccgccgacagcacgctcgcctcgcggctcaaccgccagaaccttgccatgtccttctccgtgctcgtccaggtatatgacgtgatcaccgacttcatagctttcttttgtaacgaggcgtgaacgcgagctgttctgcgattccactacccaggaatccagcacgccgcctttcatgtcgcgaaacaatcttgccgatttgtcgcaatcgaatacgcccagaacttcgccgtctttcaacacgatatgtacgattggcaaaagagtattcatgtttaatctccattggttgataattagagtctaatctgccgaaaagttcccgtaaagaattattttctcataactgattagttgcaactgttaatctgatgtatatgtttgaatctcttttgaacgtttgatgtttcccctataataagcgcacacagccaacaaccacgtggaactacaatgtttaaactttcctggatattcgggcgcaaaaaggataacgctgcctgttctgaatcggcgccggagaaagtcgcacaaatccctcaacacgatccgctcgaccccatgataaagctgggaaggattcgcggctggaacgtcgagccggagaaagccccggtcattcgtagtgtgaaagatttcctggagccgggcctatctgtcgcaatggatagtgcgtatggtgatggaccaaccccggccgcgaaggctgctgcgggcggccagaatccctatgtcgtcccgactatgttgcaggactggtacaattcccaagggttcattggataccaagcttgcgcaatcatttcccaacactggttggtggacaaagcttgttccatgtctggggaagacgcagcacggaacggatgggaactcaaatcggacggcaggaagctatccgatgaacaaagcgcgctgatcgcccggcgcgacatggagtttcgcgtcaaagacaaccttgtcgaactcaacagattcaagaacgttttcggcgttcgcatcgcgctgttcgttgtggagtctgacgatccggactactacgagaaaccgttcaatccggatggaatcacacccggctcctacaagggaatctcccagatcgatccatactgggcaatgccgcagctcactgctggctcgacggcagatccgtcttccgaacatttctatgagccggatttctggattatcagcggcaaaaaatatcaccgcagccacctagtggtggttcgtggaccgcagccgccagatatcctgaagcctacatacatcttcggcggtatcccgctcacccagagaatctatgagcgcgtgtatgcagcggaacggacggcgaacgaagccccgctgcttgccatgtcgaagcgaaccagcaccatccacgttgacgtggagaaggccatcgcgaacgaagaggccttcaacgctcgcctggcgttctggatcgccaaccgtgataaccacggcgtgaaagttctgggaattgacgaaggcatggagcagttcgacacgaacctggccgacttcgacagcatcatcatgaaccaatatcagctggtcgcggccatcgccaagactccagccacgaagctcctcggcacttctccaaaaggattcaatgccactggtgagcacgaaacgatttcttatcacgaagaactggagtccattcaagagcacatattcgacccacttcttgaacgccactatttgcttctggcgaagtcggaagaaatcgatgtgcagctggaaatcgtctggaatcctgtagactccacgtccagccagcaacaagccgaattgaacaacaagaaagccgctaccgacgaaatctacatcaactctggcgttgtgtctccggatgaagttcgcgagcgtctgcgcgacgatccgcgttccggctacaaccgactcaccgacgatcaggcggaaaccgaaccgggcatgtctccggaaaacctggccgaattcgagaaggccggtgcacagtcggccaaggcgaaaggcgaagccgagcgagccgaagcccaggcgggcgccgtagagggcgcrggcggcccggttcccgccgctccacgcgggactaagcctctcgcgaaagcggccgaggaaggggccagcgaggccgctgaaccgccgtcgcgaccggaccccaaggccgagctgcggaacttgttggtcgatcttttgtcgaagctccaagacctggacgacattaaggcgccggacggcgtagacatagagcacaatgatgcgcctggcttaaagcgcacatccaaacctggcgtgtctggtatggagccttcggtgttttcgtccaaccgcatcgtcgggcctcgtgatcattcggaactccagagaatcaaggtgaatggaataaccaccttgatcgaaaatccgcgcggaagcattcgacaaggcaaggatgggagttggcgagttcagatgaaacaccactacgggttcatcaagggaacgaaaggcgctgatggggatgaagtcgattgcttcgtcggtccgaatctgggatccaaacgggtcttcgtcgtcaaccaagtgaacaaggaaggtcagtttgacgagcacaagtgtatgctcggcttcaacaacatcaacgatgcgaagtctggatatctgtcctgcttccgtccgggctgggatggtctcggctccatccatgaagttgacctgcccgctttccgtcgctggctggcgaacggcgacaccaccaaaccattcgggggcgagtgatggcattcaaggcctccaaaaagcgcgagcgccgggcacctcttccagtcggaagagggaagcccataattccatcggcaggaatcgaggcctggtatcgaaagcagatgaaggatatgtccaagctcatgatctccgactatcgaaacgagattgagaaggcgctgtcccagcctgcggccgaacgtttcttcgccagagacgaatccgttaacgtcctgttcaagatgactcttcgaagcctacagcagcgatggagccgcatttttgaaggtttcgcggccaagatcgccccggagttcgtcaaccggaccgaagaagccgctaccgccgcgacccttcacagcttgtcggtggccggcgtcgatcagccacgagctgcgtataatgagagcgtcaggaacaccctggaggccgcaaccacttacaatcatactctcatcaccaagatccaagaggaagtccacgagaagatttacacatcagtaatgctgtctctgacttccccgaatccggaagagcaaggaacttccggcataactaacgcacttcgcaaagtcgggaagttttctgaagatcgaatcgaactcatcgcaagagatcaaacaagcaagctttacagttctctgagcgatgagagaatggcggaaaatggagtcgaggagttcgagtggctacactcttctgccggcaagactcctcgccacacccacctggagaaagatgggaagaggttcaagctgaatgaccccagactttgggagggtccgaaagcagaccaggggccgccaggatgggcgattaactgtaggtgcagaaagataccgatcatttgatatcgataggagcgctatatgccgttagttcatggcaattccaatgaggctcgttctgaaaacatcaagcgggaaatcgaagccggtaaggacccaaagcaggctgcggccatcgcttactccatccagcgcagtgagaaagggaagacggcgaaagattgttcgcctgagctcgtcgccgatcttcgcgccctggtggactctctgtcgaggctcgtgaaatgaaccgcaagacgtgccggcgccgactcgtggtcgatgtaatcagggccaatattcacggcggattcttcagcctgaagtttgccgccatcgatttggcaatcatcggcttcgccatcttgatggcttttggccgatgatactgagaaaaatctggattctgactaaaaattctagtccggatagccgcaaattaccgtttacggaaaatagcagtaatttggaaatcctactgccgcgaggctttaacagagccagttcctaatttccgatttagccgcatgcttcaaaagtatatagcctgggaaattagaagtaacgttccaatagaattcatctataagtaacgttataatataacgtcaatctatatgctctagacgtattgaaattcaatttttaatcggtaaattggtaatttgaattagtttaggagttgaaagcctcgcggcagtaggcttagacaaatcccgtcaagtttccgagaccaaattaccggattttcgcggctgaggaaactggtaattagatcataatacaaattataatgtaagttaacagtcacggctacatctaattattgttccgcttatttacccttagatgtactgcgtatataatacagccatagtccacgactcttcgaattaacgatggcaaagtcgaaaagaaaaattgacgaaaatggatatatgaccatagagggctgcccgatcagctcttatggcgttttccaatattctgctggtcaactcggtcttccgggcgatccgacgcggattgtcaacgtatatcgcccggagtctgccgtcagcgatccggagtacatcgaatctctgaagaatctcccgttgatcgacgagcatgagatgctgtcgggattcgacgatgatgacgatagcgtggcccccgaagacaaaggggtggagggcatcatcacatccaacgcttactacgaagccccatgggcacgcggcgatatccgcatctattcccgcaacatgcagaatcagctggaaaggggcaaagaagacctgtccctaggctatagttgccgctacactgagcaacccggcatctggaacggaacaccttatgaagtcgtccaggacaagatgcgcggcaaccacattgccctggtaaaagagggtcgtgtgccgggggccagagtattggatggtctgtgttttgaccatctcagttttgatttcagaccatccgatgagggtaatgaaatgagtctcaagaaagccaagcggaagccccctgtccagcgcgtagggcaagctgctgactcggcggtcgaagagttgcgcgccctgtggccgaagctatctgcgtctgtccagaagttcctgggcgaagaagagcaggagccggagcatcaggaaggcgcagctccggccgaaccgaccgacagcgagcacctgaccgagcatccgactctggaaggtgctcagaaggatgacgaagagcaggaagaggagccttccgttgtcgatccggccgtggccgccgtcgagccggagcatcaagaaggtgccgcatccgaaatgtccggtgaaggcgaagtcgccgaactgatctctcaagtcaaggccattctggctcgactggagggcacggtagccgaaggggcggacgaagagcatggcgaaggtcaagatgtcgtcgagggcttggaagagcagagcagcctcagcggcgcgcaaaccgccagcgacgatggtggtgagggcaaggataacagcgaggaacttcctgaaatggcacagaagaacgcgcaagatgctgcaattcgcggtctctatcgcgacattgctgctaaagatcgcctctacaagcgtcttagctccgtggttggtgcgttcgatcaccgagctatggactcggctgaagtcgctgtttacggcgtgaagaagctgaatatcagctgcgcgaagggccaggaagcactggcgctcgacatgtacctgaaaggtgtcgaagccgcgcgcggcgcggccagccgtcaatcgaaagcccaggattcggccggttctgctccgcagtgcgccgagctggacagctacctgaagggggagtaactcatgttccagaaacaagtttaccgccagtacactcctggttttccgggcgatctgatcgaggacggcccgaagcgggcgcggccgggtcgaatcatgtctctgtctgccgtaaatccggctgccaccgccaccggccccaaccgcataagtcgcgctttcggttacgccggtgacgtcagctccctcggcgaaggtcagccgaagactatcgcggctcgcgcttctgaagtcgtgatcggcggcgccaacttctttggtgtcctcggtcatccgaagcactatgcgctgttcggttcggccggagactccctggctcccagctatgatctgcccgatggcgccgaaggcgagttcttcgacatggccaccggcctggtcgtcgaaattttcaacggcgccgcaaccgccctggacctggactatggtgacctggtcgcctatgtaccaaacaacctgcctaccgccgacaacgcgcttggcctgccggccggcgccctggttggcttcaaggctggctccatgccgaccggcttggtccagattcccaacgcacgcatcgttaacgccatcagtctgccggcccagtcggcggggaatctggttgctggcgttaccatcgtccagctcacgcagtaaggaggcgtcatgagccagattagcaagacccattcgcgcctcgcaggccgcaatgcgaaacctttcgacctgaaaaacatcaccaatgacgccgtggcgtctctgcgccgcatcggcctggtattcgatcacgccgtcgtccaggaccagatcaaggccttggcgaaggccggcgcgttccgctccggctcggccatggacagcaacttcaccgccccggtgaccacgccgtccatcccgactcccatccagttcctgcagacctggttgccgggcttcgtgaaggtcatgaccgctgcacggaagatcgacgaaatcatcggcatcgataccgttggctcctgggaagatcaagaaatcgtccagggcatcgtggagccggccggcactgcggtggaatacggcgaccacaccaacatcccgctgaccagctggaacgccaacttcgaacgtcgcaccatcgttcgtggcgagctgggtatgatggtgggcaccctggaagagggtcgtgcctcggccatccggctgaacagcgccgaagccaaacgccaacaggcggccatcggtctggaaatcttccgcaacgccatcggcttttatggctggcagagcggcctgggcaaccgcacctatggtttcctgaacgatcccaacctgccggcattccagaccccgccgagccagggctggtccactgccgactgggcaggcatcatcggcgacatccgcgaggccgttcgccagctgcgtattcagagccaagatcagatcgatccgaaggcggaaaagatcactctggccctggccaccagcaaggtggactacctgtcggtaaccacgccttacggcatttcggtttcggactggatcgaacagacctatccgaaaatgcggatcgtgtcggctccggaattgtccggcgtccagatgaaaaaccaagagccggaagatgctctggtgctcttcgtcgaagacgtgaacgcggccgtcgatggcagcaccgatggcggcagcgtgttcagccagctggtacagagcaagttcatcaccctgggtgtcgaaaagcgggcgaagtcgtacgtggaagacttctccaacggcaccgccggtgcgctgtgcaagcgtccgtgggctgtggtgcgctacctcggcatctaacagatgcctattcaccaaaggccgggcttccggcctttgttcactctgactctaactcggttgtaggggccggttagggcataattactaggactacgccaatgactgtttatatcgtttcctccatgactcaatcggtgtcttacaatgcgtatgacacctctgatccgtccaatcctcgcctccagcgaaagattctgattcgcggccgcgcaggcatcgcatccgaaacttccggcttcggcgacatgatttccgacgaggcaggacgtccgatctggaccccacagggcgattgcactgccgtgagcgattcggatttcgagctgcttcaggccaataagattttcatgcgtcacatggagaagggttatctgcgagtcgtgaagaccgacatcaccagtgaccaccagcggatttccaaagagactcgcaccatggagcgcgatggattccagcctctggatgctactcgcctgcagcagaaaatcaaggtgaccacagccagcgcttcccaggaacaagagttccggatttaaccgagggtttcggcatggtgattttcgacgaaaataagtttcgcacgctgtttccggagtttgctgatccagccgcttatccggacgtgcgcctgcagatgtatttcgacattgcgtgcgaattcatttctgatcgcgattcgccataccggattctcaatggcaaagccctggaagcgtgcctgtatcttctgaccgcccacctcctgtcgctttccacgatgcaagttcagggcgcggctggaggtggcgtcactgccggtgggacccaaggcggtttcatcaccagcgctacggtcggcgaggtcagcgtggccaagctcgcgcccccggccaagaatggttggcagtggtggctgtccgggacgccttacggccaagagctttgggcgctcctcagcgtcaagtctgtgggcggattctatatcggcggccttccagagcgccgaggcttccggaaggttggagggacgttctggtgatccctggcgcgaatcttctgcgaatggccttcggggtcatcggcactcaaattgtgagatatcgcaagtttgagcagcgagtgaagaatgatcaagcccagtatgtctccatgttcggggagcctttcgacctggcagcgtctgtccagcgagtccgacgcgatcagtatgcccagtttaatctggagttccaacggaattatgttatgatcttcgccaactttgatatggttgacttggatcgcaatatggccggtgaccagttcctctggactggaagagtttttcagctggagtctcaaggctcctggttttatcaggacggctggggagtttgcctggccgtggatatcggtgcggccaagctcactgatgacgggaaaccgactttctaggtggtgtatgtttgacggcgaactgatagcgaaaatggttgtcgagctgaatgcggcgatggcatctgctcaagaggctttgcagttcccggattttgaagtcgtccagaaagctcagccgacccaacaggggacgtcaaccaggccgaccatctttttccagaaactgtttgacattcctcgcggctggcctgccaccgattggtacctggacaacacggcccgcaaatatgtggaaataactcgacagcatgtagagacgactttccagatcagttcccttcattggcagaatcctgaaatcactcacgtggttacggcttctgatatcgccaactatgtgagagcttatttccaagctcgatccacaattgagcgcgtaaaggaactggacttcctcattcttcgcgtgtctcaaatttccaacgaggcattcgagaacgacaatcaccagttcgaattccacccaagttttgacatggttgtaacttacaaccaatatattcgcctgtacgaaaacgcagcatattcggccgatggggtattgataggcatatgagtctgaggcgcgattcagagctaatcgccgcgcacctccagatgttaagagccatgcgcggcaggtccgtttcagccggatggtattccacggctcgatatcctgacaaggcaggcggatcggtcggaatacaagtcgcgagaatcgcacgtctcaatgagtacggcggaactatcgaccatccgggcgggaccaggtatattagggacgccattgttcggggccggtttgttggcgttcggttcgtcagaaacgactttccgggagaaaccgaggtaactaagcctcacagaattaccatcccggctagaccgtttatgcgatatgcttggaacttgttttccgcagatcgcgccgcaatccagaaccggatagccatgaggctggccagaggacagatcactccagatcaagctcttgcccagatcggcctggcattggaaggatacatagccagaagcatcaggaccgggccatgggtggctaactcagcatctacggtcaggagaaagggattcaacagaccgctggtcgatacggcgcacatgcttcaatcgattagcagcagagtaacataaccaggagatcatccagtgatcagtcagagccgttatatccggatcatttcgggcgtaggcgcaggcgctccggtcgcaggccgaaagctgattctgcgcgtcatgactaccaacaacgtcatcccgcccggaatcgtcatcgagttcgacaacgccaacgcagtcctgtcatacttcggcgcgcagtcggaagagtatcagcgggctgcggcttatttcaagttcatcagtaaaagcgtgaattcgccgtccagcatcagcttcgctcgctgggtaaacaccgccatcgcgccgatggttgttggtgacaatctgccgaagaccatcgccgatttcgccggcttctcagcaggggttctgaccatcatggtcggcgcggccgaacagaacattaccgccatcgatacgtccgccgcgacttctatggacaacgtggcgtcgatcatccagaccgaaatccgcaagaacgctgacccgcagctggcccaggctaccgttacctggaatcagaacaccaaccagttcaccttggtcggcgccaccattggtaccggcgtcctggccgtggcgaaatctgccgacccccaggacatgtccaccgccctcggctggtccacctccaacgtcgtcaacgtcgccggccaggctgccgatcttcccgacgcggccgttgccaagagcaccaatgtcagcaacaacttcggttcgttcctgttcgccggtgcgccgctcgacaatgaccagatcaaggccgtgtcggcctggaacgcggctcagaacaaccagttcatctacacggtcgctacttccctggcgaacctcggcactcttttcaccttggtgaatggcaacgccgggaccgccctgaacgtgctgtcggcgactgctgccaacgacttcgtggagcagtgccccagcgagattctggctgccaccaactacgatgagccgggcgcttcgcaaaactacatgtactaccaattccctggccgcaacatcactgtttccgacgataccgttgcgaacaccgtcgacaagagccggggcaactacatcggcgtcacccaggccaatggccagcaactcgcgttctaccagcgcggcattctgtgcggcggtccgaccgatgcggtggacatgaacgtctatgccaacgaaatctggctgaagtcggctatcgctcaagcgctcctggacctgttcctgaacgtcaatgcggtcccggcgagcagcactggcgaggcgatgaccctggcggtgctgcagccggttctggacaaggcgacagccaacggcacgttcacctacggcaaggaaatcagcgccgtccagcagcagtacatcacccaagtcaccggtgatcgccgcgcctggcgtcaagtccaaaccctgggttactggatcaacatcaccttctccagctataccaacagcaacactggcttgaccgagtggaaggccaactacacgctgatctattcgaagggcgatgccatccgcttcgtcgaaggatcggacgtgatgatctaatggtttgcggcggactcgatccgccgctaccttccataaatggagtgaggaataagcaatgatcaacatttctgcgttcggctcgatctgccagttcacggcaagcagaactttcccgaacggattcaccgtcaccgagtttgccgacgatgcggaccccatcgacagcccgccgttcactgcggccgataccggcgtcggcctcaacggtgacatggtagtctggaaccgggcgaacatcctggaagtagtcgtcaacgtcattccgaataccgagggcgagcgcaacctggcagtcctgctggatgccaaccgcaccggaaaggacaagtcgggcgctcgtgatgtcgtcggtttggtcgtggcgatgccggacggcagcaaaatcacctgcaccaacggcaccccaatcgacggcgttctgatcaacgcggtggcaagcgtcggccgtctgaagaccaagccgtatcggttccgatttgaaaaagtgatcaaagccggtactagctgatgaagaaaattccgctgacagcagtccccaatcaagcgatctcatttaacgccggtagcagctattggaagattcgcctgtaccagaacatggacatgatgaatgccgatatcagccgcgacggcgtgatcgtttgccatggggtccgctgcttcggcgggattcctcttctccaatacagccatcagtaccgacctgactatggcaatttcgtcttcgaccgcgacgccgattggacattgttcggcgacggcatcaacctgttctatctggacggcgccgaattcgccgagtatcaggcgcttgccacgaggaaagaatgagcacatcaacgatcagaaccgggacgaacaacgatatccttttggacgacaatggaaacatggttatcctcagggatgtcgaagcgtgcgcccaggacgttcgggcggcgatgctcatgcgcaccggcgaaaacattttcgatgtgaactccggtgtgggatatttcgaatacatcttctcgccgcagaaaagctatgatgacgctcgcaaatccatcgcggatgcaattttatcctcgccggatgtgaccggcatcgagcagcttgacatcgacataaccggggaagtcttcggcgtcgatgcgaaagtcatcaccatccacgggcctgttaccacaggagtttgaaatgagtaccatccgcatccaatacgccaacggcacccaactgttcctggacggcaaaaatccgccgcccctggacccgctgccctcgtttaacccgtctgtcgaagatctggaaggcctggaccgcgaaaagaacaccgacaagggcgactcctcgccggccggtcttcccgttcccccggtaaacgtcgattccaatgtcgacaacggcggaaccatcccggctccggtatcgaccgacgctcctgcggccgaatcggccccggaaggcgcccaggaagctcctgcagcgggccaaggcgacgagaaaggcgctgaggaagccccgactaccgccccagtagaaaaggccgaggaaacggcctcgccggccgctgaagaggaagccccggctcccgccaaggccacctctcgcaaaaccaccagcaagtaaggactcgacatgatcaacgtcagcggcttcggcacaggaattgtaatagtttccgcctcatcgttcccgatggggttttccttgtcgaagttcgctgatgatgagagtcctatatcctccaaagagctggagccgttcggatatgagatgctttatgacggcggcctattcgcctttgacaaggctgctcctctggaagtatctgtatccgtcatcgcagggagcgaggatgatattaaccttcgcatccttctcaattccaaaaagggatcattccgatttcttccgggcatcatcccggatatgacgactctcgtggccactcttcctgatggcggccgcaccgttctgtccaatgggactatcatcaagggtccggccatcgacaccatacagaacaacggacgacgcaaaggcaacacgtacacttttgttttcggtagctatcttggcgcccagactgcgcgtcaagccatttctaacgttatccaatcggtactggaggtggtctgatgttggggattttcaccagcctcctaagttcgcgatctttttcgattgtggaccaaaacacaaaccagctagttgctgcggatttgaggataagccgggccaacacccggttttcttctgtagggcaacgccacatgctggaagatggtacgaccaagatggattccagaacgatccaccctatggaaatcatcgtcgaagtattttgcccttcaattgatgtcgtcgatcagatcaatcaattgctcctggatcgcgacacactgtacaaagtcatcactcgcggcatggtattcgaacggatgatgtgtaccagcgaagcgctcaatcagactccggatatgatatcggcgactcctgcgcggctgacattctcccaagttctcgtccagaatcccaagcctataatgttcagaaatgcaggggactcttctatgatcgaccgagggctggccctagctgaagacgtggttggctcggccggcgatctgttcgactacgcagtgaacggcgtccagaacgccgcagacttgttctgaggtgccaattgaactctttcctcaagtctattctcaacacgcctactctcaccatacgcgatgatgtcaccaaacttcctgtctggaagagtcttcaagtcaagaaagtggaaatttactcgccggcttccgtagtgtcgaaacctctggcgacgaaagaccagacggaagctcaagtgtacaccgaagctctggacattgatgtgaagaatggaaagatcatccaaccggtgcgactccgcatcaatgctatctgtccggacctgtccaccgttgaaagtatcatgaacgccttcaatgataacacctcgactttcgctatcacttctaagtcgatattggccgataaaatggccatcatggcgctcgatgtagatcagtctccagacatgttgaacgcggctgagatcaatatggaattcgagcaggttgagcctccagtattgaataaattcgatcctgcgttccctcaagatagtccgacttatggggtacagattcaatctctttctgatgctaatttgctggatttgggcgccatcggcgattcgatatcttcggccgcaaaatcgctatataatcgcgtgaccagctacttctgaggatgtatcatgcttgaaatcaatcttcccgatggccgtcaaactcgcgtacaaatcgaggcgtggtcggcattggatggctgggaactccagcgccgtttcgtcgaattcgctgtcagccaagattccgacttccgccgctctttcaccatggaaatcctgggctatgcgaaagtgctgcttggcgacgatgacaccggcattccgctgaccaccgcggcagtcatcaacaaccacctcggccactggaagaacgtggaactggttttcaactctgttctcaagcacaatggcatcgacccggccacgcacgccgaccggccggactattgggaacaagtcggatcgcagatggccatcgcatttctggccgaggcgtccaagctcattggtccagcaatgaagatcgccgaaggactcgccaacaagccggagtgattcatgtctagtgatttggatgaattcatacttcggtatgaggccgatactgccagagccgagcgcaatctggagcgcctccagaaccagatcaggcgcgtgaacagcgcatcgacgagtggccttcaggatttgcgccacttcgcagacggcgcggccactgaactcggccgagtcgttccgcagatcgattctgtgacgagcgcgattcgcgggatgaacgcgcaactggcgataggcgccactggcgtggccctggtcgcggccggcgtcaaggcgttcatgaacaccagggaccagtacaatcagcagcgcatccaggcgatggatatcggcatcgccccggcacgcttggaagagtaccagagaaaattcgttcgccagtccggtggaaccatcagccgcgagcagggcgcggagatgaccaaaaatctggcagacactttccggcgtgcttatcgcgatatcgggcgagtcggcccggaagcgcgaattctgcgtatggccggcgttgatgtcgggagcttccaaaagggcatgcggccgctcaacgacatcattactgatctggccacgaaaatggccaagctgaagccggacgaaatttctgcctacgctgatgcccttggcgtctcgcgagactacctgagcaccctggctaagatcggcccggccatgggaaaagtcaccgagatgacgactgcggaactccagtccagggtccagggcgagtccaacattcagaaattcaacgatgctctggcgaatctcaaccagacgttcaccaccctggaaaaccgagtcggcgaaaagctcgcgcctgcgttcaccaagctgatcgaaatcatcgacaagatagtccaggctattcccaatgaagtggaaagcttcgcgaaggacaccaaatcccgttgggaagatggagtgctcgggaaggcgaccgttggcagtgatatcctatccctcctcagccccggcgccctgctcggtcgcctggcagcgtgggggactcgtcgcggcatggaagaatcagggctcatcgacaaggacaaggttcccggcgctcaaaccagcgaagacctggccaagaaacaagaagaccaggacaaggctactaagtccatgaaagagctagagaagctggctgaccagaccacgaagtctaccaatgattttgcggtggcgatcaacatgttcagtggcgcggtatcgtcgttcgcgaatgccgttgacgagcgccaagcttgggcagcctgggcgggggaaattggtcgggcggtcggtatgggaagcaccgcgccgacttcgcgggcaaccggcgtctatccgcacgcgatctatgatcagtcgaagagtggcgcggccggacaagtcttcggcgagccaatcggcgcccagtctcttcgcaatcgcatgttctcgccgcagcgcaaggcagagccggtcaccgttccatcgtacatcaacgatatcatcaaagatgcttcgaagatgtacaacattcctgagctggacatcaagaaactcatatacaccgaaagccgattcaacgccagggccaccagcgaagccggagcgaaaggcctcatgcaactgatgccggaaatcgccaaggcgtatggtatcactgacgtatatgaccctcgccagaacatcctcggcggaacgcgcctactgcgtgaaaacctagatcgagcaaatggcgacatgcggttggccttgacatactatcatggcggactcgatccgaagaactggggcccaaggactcgcgcatatccgggtttggtaatgagcgctccaatcgagctgatggaagaggcgcagcgcaagcagaaggctgcggccatgaccgccgccaacgagacgttcgctccggaaggcggcgacatggacattcgcccctatgatggcggacgattggaaactccagaccagggcaagaaggaagatgagcgccgcgaagcccgtcgatatgacgacagggttgtgcgaccggaaattcgcatcatcgaccgcatgccagaccgcagcgacggcgaaatcctcaagatgtctaggcgtcaagaggccgaccgggcagactctggattccggaagttcccgaatcaggttcgcggcgagaccaagcagaacatccaggcccaactcactgccggagccatcgcgcaagtgatcggcgttaaccccaaccagatcatgcgccgcgaaatcagccgttctgacttgctgttcggatacaaccaagccatcctgggcaagcagcaggagatcaaggccgccgcgaccgaagccaacaacgtattcctgtctccagccaagcttgccgaagccacggccaaggtgaacgccgcatcgcgagaaatggatattctcaggacgtacggcgagcaacttctgaagagcgctccagagcgcggccaggagctgaccatcggtcggatcgacatgttggtcaacgtcaccggcgcgaattctccggaagaggctcgtgagatattcagcaagcagactgcagaccagctgactacggcaatccaggacgctcaaaacgattccgcaactaagatactctactgatgaaaaagagaattctgcgagtaacattcaacatgccttatggacccgaagtcatccgcgaagatctggatgttcgggtccggattatgaaggctgcgttgcggattcagaaccgggcgacgatggaaattttcggcctcaccactcagctgcgcgagtctcttctgtcgcagttcaccgcgtggaagcaccggcaacgtcaagtgggcagggaagatgaattgatgatcaaggtgtcggtggaagccggctactctgaccaggggcgcgagcaagtttccagagtctttgtcggcgaagttgccattgtcgatatcatttctccgccaccggacattggaatccgcatccagtgctataccaggcaaatcgacaggacgaagaccattcggaatatgccgcccgccaacacgacgtttgtcaagttcgtcgagtggggcgcgaacgaaatgggattgaacttcatctgcgataccagttacaacgatcaagttctgaagaatccgggccggtctatcactgtcgcgtcggcaatcctggcgtcgattcaggatatgtacatgccggacgtggccgcgttcgtcgatgatgacatattgatcgtgaaggaccgcgataaagtcattcgtccggatgaggtgaccaacgtcaactcgtttgttggaattccatcttggtctgaatggggcgtggaattccagtgtctgtttgagccatcgattcgtgtggctggaggcgtagcggtcgaatctctcatgaatccaagtgttaatggtaactatgtaataactgctctggaatacgatttggccagtcgggatcggccgttctatatcaaagtcatggggagtccagcagcataatggccagggaaatcaaatcattcaacatgttcggagttcactatacttcgcggcaattctctgccgtcgatgggctcagcatgatgtcggaaattcagagcgtgccgccagaagaattgctcaagggtactgatgtattggcgcatccggaagaccatccggaaggcatctggcttccattgactgctgcgaacatcaatctttatgtcgttgatcgagcgaaagtaatagctcccgtacaagttcttgcacttctgtccgaagtggtaatcgactggaactttggttttctcaaagactggaccggagtcaagattccatccagatttgtcgaagatatcaaaagcgtgaagacggcacattcaccttctgtagttgcgagcttggtcgcgaacggctcagcctctatgcgcgagttggaagagtattattcgactcaagatgcgtttaagatgatagacatcatgacggcgaagagcgtgaatgaggctctagcgtccgaagcatcacagaacagaatcaaaaagggataattcctaagcgagcctgggaaggctatactagaccggccaaatcagaggctttcccatgtccaatattcctttaacatcagcaaaatctaccgacagaacgcgactgatcgccgctcttgacgctcggtcgcggcgggacgcgctcgactttgaagtcatgattcccgcccaggttgttcaatatgatcgggccgaaaatatcgccacaatccaacctctcatcacctgggttgatactgaacacaatgccgtccagcgacatcagctggttgacattccggtgatttccatgggcgctggcggcttccacataagtttcccgatccagcagggggatatcggctggatttacgcggccgaccgcgacacttcccagttcttagagtcgctatcgatgtcgaagccgaacaccggccgcatccacaaatttgaacatggaatgttcatcccggatgtattccgccgatacaccatcaattctgaagactcggccgcgatggtcatccaatcgactagtggagcgacccggatttccattcgcggcgacaacatcaagatcactgcgccgtcgaatgtcacagtagatactccgcaggcgaatttcactggaagtgtgactatcgccaacaccctggttgtaaacggcgtcaacgtgaacaaccacggccacctcgaaaacaacccgcctgatgccaggacgaaaggcggcatgattgcttaaggagaatttcatggctaattttgatttttctgatttaacagcggggggggtgtaatggctaattatgactacatagtagatactggagtcatagtcgccgatactgctgacgttttgaaagacgttgaagcggaattcagagcggccctcggcgccaatatcaacctggcggcttcaacaccccagggaactctggtcgcggctgagaccattgcgcgttctagcgtgatgaggaatgaagctcgcattgccaacaccatcaacccaaacgtttccttcgggacgttcctggatgccatctgtgcgctgatgggaatcgagcgcggctctgatctttcgacgttcggctatggcgtccaagtgaccggccgcagccagacccgaatttccaccgggtcgcgtgtgcagactccggccggagcgattttcacggtcatgagtgacgttctgattccggcaaccggagtcgccaccatcgacgtaaaatcgcaggactatggaaacatccctcttcccgtaggaaatctgatcatcatcgatggaaccatcggttgggccggagcgaaagtaatcgcttcaactcgcgtcgatcctggcagccgccaaatgaccgatgcagaattgaagaatgctcgcgtcaatcgtttggcgatccaaggtcgcaactcgactttggccattaaagcgtatgtcagcgccgtacccaatgttacctcggtcaacgttatcgaaaacaataccggcacggttcaagttgtcaacggcgtatcattcacccttccgtatgcggtctgggtctgcgtcgccggaaatccggataaacaggctgtcgcagatgctctgtgggcagcccacaacggcgggactccctgggactatggcgcggccaataatggcgtcccggtggatgggcctactggcgttcctgttcgcgatccggcatccggtcgaaagtatgtcgtgaagtggactactccgatcatgtatgacggatatgtaaacgtcaccgttcagcagggctcttcctcggtcgctccggaagcaatccaaaacgcagttgtaaattacgcccaggggaaagtggagggcgaagaaggattggtcgtcggcgcgagtctgtctgcatttgaagtggctggggctatcgctcgcgagattcccggtatctacatcaaactatgccaggtggcttgcgtcgcggctggatcgccggccccggctcccggcgacttctcgccagaatacgtcatgagcgcattcggtcaggctaccatttcggtaggtaacgttagggtgactttcgtatgactttgcctgcgtacaattccgatattcaacaggtgctgaagtggctccaaaaccaggctcctgggatcaccggcttggttcagcgaaaagctcaatggtatgatcgtttcagccgtcaattttgggtgaactgggagcgcgacgttttcaatttgaagactgccaacccgttcggccttatggtgtggtgcatcatcctcggcacgccttcgaaaggcttcggcctgtatccaaaaaacagctcttgggcgttcggtcggctgcgccagaacttcgtttatagcgggaatcaggttccgccgcctgcagacgcatcgccgggcggcaacttctacggtggcggcaatgccgaaatcctcaacttggacgaaatcaggaaagtgcttcagctaagatatgtagcgctgatttcgaacggctcgattgcatatatcaatcgcatgcttcgctacatattcaacgatgatgagccgtgggacgaggcggccgggttgtacttctatctcatggactcaaccggcgagaatggacctgtggagaacttggccatatatcggaaagattgggaaggaatggtgttattgtccagttcgcccagaacgaaccacgtactgacatcgacccctgccagcgacgccgattggccgggtgtcgatccggccgcgagcggccgtccggtaacggtcgaaacggcgtccgctacggccccggacggctccgctacggtgtgcaagcttactaagccggccgggagtaccgcctacgtctccgcgccgatagatgggccgctggggtccggtagcactgtaacgttttcgttcttcgcgaaagccggatccacccgtttcattgcagtccaatcggctgccgatttccccagtcgcgccgatgccgttttcgacctggactccgggaacgtgatcagcgatcagatgttggacagcagcgtggtaagcgccagaatgattcgtttggaaaatggctggtggcgttgcgttctcacgaccaagaccgtcagctcttcgttccgcgctgcttacgtcgcgccggcagaaaccaacttcagctggattgattctaattcaagtatggcgattgacgtgcttatctggggcgctcagatcgaactgggtgatactccaaccggatacttggagactaccggggcgcccgtaaccatcaccgattatgtcttgcagaatgcccagaccggaacggtcgatttcacccagccccttccgattggagtagaagcgtattggactggcgactggaaaggcgggtctgcgaccgagccggccagattcgcggtagggggtgggactcaagatacattcaatctgtccagtcctgcatacatcggcctacccactagtggggcattcaagttagaatacagagttggtccggcgcttaatttgtcgccgcaattgatcaacctcatgaatgaccgggcggtcggtatcatgccgacttgcgccggttgcgatgtaaaagtcattcaggagtaatgacgtgatcacacccgaactgatacccagtccgtttgctgcgcagggcgacaaagacccgatcccgcagacctcttccactggctttgccaaccttcgcgatggctacacgccggactacgaaatcagtctggcgtcgaacaacccgcaggccaaagcggtcgagcggaaaattcaaaaccaactcttcttcatcgcgacccagaacgcacaggcgtggcagcggcaaatggcgccgccgtggtttcagggcatgccgggcggctacgaacagaatgcagaagtcgtgcgcgtcggaaatgacggcataatgcggcgctatcgttccatggtgaatgccaatgcgagcgaccctcttagcagcacgacttgggaagaacaaccagcctggtcggtgatgcgctccagcatcccgatgccggctggaggcccaggcctatcttctggcggagaagtcatcacgactggccgcaacttcaacgatttgttgaatgggacgtgggagttcttctctgattcagtagtcgtcgcttctcagaacgcccccgtatatccggcgtccgctggtgccgcttctggcatgttggaggcgaaatcttggatatccgggtccaatacgttctgcgttcaacgctacactgaccgcgtcgggaacgtcgctgtgcgcgggcttaatgccggggtatggaccaactggatgtatgctgtaaacgtcatggccctccaacaaggtcgagtgacctatggagtcgcggccggcccggcgaacgcttacacgttgacgctcgttccgcagctccaaggcggcctggtggacggcatgatccttcgggtcaagttcaacaccgtgaacaccggcgcctctaccatcaacgtctccggatttggcgccaaggccatcgtcggcgcggcaaacttcccgttgactggtggagaactcggccaaggactcatcgctgagcttgtattcgacgccaccggcgaccgctggaggattctggcaggcgcgccgcgcatccaagtgggcaacgcagatcaggactaccaggcccccagctggaaacaggtgaaggactatgtcgcgtcccaaaagctcaccgaagtggattgggccgatgtcgtcaacaagccgaacgtcgccatccaagacacaacgccgtggttcgccaatttggagctgtctgacgctcggcctttcatcgattttcatttcaacaacaaccgcgccaaagacttcgactatcgctttatctctgaggctgatgggtcgatggcattctattctcgccaggggtctgccggtcctacccaggacatcctgttcagcaggtcgaatgtaacattcctccagccgcgactggatgttgcgaaaaacctcgcgtacatcgcgaactctggcccactttggcagaacaccactgccgatcagcctggttggaaattcaccttcgcccaaggtgtggacgccaacaacaacgctgtgatcgcagtcaataccacaaatccggacggctcttatcgctcgcaaatcatgcgatgggattgggcgtcaacgaacgtcatattcaacaatcgccctctgtttgctggacaatatgttccgtgggactccggaaacttcgatccggccaccaagctcactgtcgggaccaccaacaacatttcgggaccgaccggaattcgcaataccaccagcaataccggaaatatgaacacctggggctccagctccacaactgcatcgtatggaaacgcagcccttcaaatcttcggtagagggggtggcgagcctgcggccatctacttcgacaactcccaaaccggctggtatttgggcatggacaaggacggccaattgaagcgagcaggctggtcgctcggcaataactcctatgtggtcactgacgagtcgaatattcggaatcacgtcaatggaatgtctggcgctcctgtttggggaggtcaatggttctggggtgaatggaacttcaacccgaacacaaagctaaccatcaaagccggcacgcaggagactagcagcactgcgatattcagcggaaccctgccgtttgcaccaatcgcgtctctgtccgactattcccaggcgcccctgacgatttataactcgccgactgggccatctgctaagcctgctgtgatcgcgtttattcgccctgggaactggggcgcgttcttcggcatcgataccgacaacaagctgaaatggggcggcggatcgctcggcaacaactccagggaaatcgccgattccagcaacatcatgaatctttgggcgtccaacccgaccgcgccgtcctggaacggccaaaccgtctggcgatccggaaactttgatccggcgacgaaagtggatttgaacgccgcgaacgccaccaacggcaacatgatcttcaaccgcatttcgggtactggtagcggcatcgcttcgtccggtcgagttggtgccatcaacctacagaatggcgcgcattcagggcaagcggccgcagtcacattcgagcggggcggaggtttctttgtcaacttcggcctggataccgacaacgttctcaaagtaggtggcggaaacctgggggcaaatgcctatccggtcatccacgccgggaactacaataactacatcaaccaggcgctggttcaggtgggtcttggcggagtcggttcctatggcatctttgcggttctggacaatgccgctccaaccgcgaccgttcaaccgggagtggttgtggacggttccattctcatctactcgtcttgcgccgcaaactacaatagcggtcaaaggcctgccggaacttggcgctgcatgggatatgtagtcaaccgggatgccaacactcctgactccgcgacccttttccagcgagtgacgtaaaatgaaatggacgcggatcagaaaccctcgttggctggatgaaacaaacatccacgccatggtgactttcgatgggatcggggaagttcctttcaccgccaatccgcacgacgtggaggcccacggaagggccatccacgctgcgatcctatccggggcgcacggacctatcgccccggtcgatgcgaagcgggagcaggccttgcaggacgctatacgggccagggaaaagcgggctatccttcgtgatacccgctggcccatagatcgtcacgacgagcagaggcggctgggtatcgaaaccacggacggacctgggttgatagcagcccttgctcactggaggcagcagattcgcgattggaatagcggggatcggccgcgacttcccatggctctgaaaacgatgttcaaaaatcaggagtattgatgaaaatcacaaaggatattcttatcaccggaaccgggtgcaccacggatcgggcgatcaagtggctggatgacgtccaggcggccatggataaattccacatcgagtcgccgcgagccattgcggcctacctcgccaacatcggagtcgagtccggtggactggtgagtctggtggagaatctcaactacagcgctcaaggattggccaacacctggcctcgccggtacgcagtagacccgcgagtccgcccgtatgtcccgaacgctctggcgaaccgcctggcccgtaacccggtcgccatcgccaacaacgtgtacgcggatcgcatgggtaatggatgcgagcaggatggcgatggttggaagtatcgcgggcgcggcttgatccagctgaccgggaagtcgaactattccctgttcgccgaagactccggcatggacgttctggagaaaccggagcttctggaaactccggccggcgcgtcgatgtcttctgcctggttcttctggcgcaatcgctgtatccccatggcggagtccaacaacttctccctggtcgtgaaaaccatcaacggcgccgcgcctaacgatgcgaaccacggccagctccggatcaaccgctatatgaagaccatcgccgcgatcaatcaaggctcctgatattccacccaaagaaaaggccgcttattcagcggcctttttgctttccggctttgcctcttcaaccatcttgacctcaaccggcgcggcggactcctcctgagtgatcgagtccacatagttccctagtgaactcagaacgccgattaacagcgctcttaccaccttgtccttgactgtctcgcctatgatcttggtcagaacggatattaactcttcccggagtctggggctgattcttggccgaaagcgcttgcgatgctctttgcgtttcatgtttagtcctctgtctgcggtcttctcctcaccccgataattgcttggggatgctttgtgttaatcggaagggtcgggcgctattataacccgtcgaaaatgctagcgcttaactgtttaacgatacgcaccgcgatattaaatcgccttctttctggccgaggaactctggcggccgggtccggtctaaggcctaatttgtcgacattaaaacgataaaacccggatcgcctgtagggtaaggcgtccgggtttatttcgatctagtgtccgctagaatcagtggcttccgccccatccgtccagccagcaatcgaagacggcgtgtctcggcttgtccttggcgccatgggagaagtgcttgaatcggatgacctggcccttgaggtattccctgtcattccagcggcgctgtttctcgtcgtgggtcaggctggaggccgacacgttgaaggtgacgccaggccacagacgttcgttgcggcagacgaacgcgccgaccattccggacggcgacaggttttccgcatgactggagcgggccgtgttaccaagttcattgatgaaagcttcattgttgttgtgcatcaactcttccacgtcgatgatctcagcttcatcgtagtcgtagcgcttgactttcacgcaatgcccttccttggccgtcgagcgaccgaacttgtacagtccatcggcgcgcttgcccatggaaccttcgaatcccagcatcgtgtggcggcgctcgacttcgctgaactgttcgatggaagtcaccagctcctgctcgaccaggtgaatcctctcatagccgatgcagttgcgcaggaagttcacgcgctcagccgccatggctaggcgctctttggtcggtgcgcgaggatcggtgaaatcatcgaacacatggaaagaccagtccggctcaccgctgtggcggcgaagatcgccagacgacttctggaaaactttcgggtcgctaatgtcgccgcagaccagctcgccgtccaggccgttgaacagtttatcgctgaggtattcgtagatcgattgattgttctgccgcttgagttgacgagtcagcgcctcgccttcgaatacgaagcagcgaaatccatcgatcttcggtgagaaatacatcggcagttggccttccagcagcttcgggtcaaaattcgatgcgagcatgggtttcatacagttctccagaaaagaagcccggcgaaccaggctaaatggcggtaagccggctcagatggtttcgttggcgtggttcagctcggccatgatcgatgcatagatctcgtccgactccttgatgaatacgccgtcgtacatgacgcctttgcgatccttgatggtgtcataggcagactggtaacaggcgagcatggtcgtttcgtactcttcagccgcatcgaacagggaagcgacggccagaaccaatctcttgatggcaaacccctgatttccgcgtgccagcgcaccggccaaattgccgagttgcttcaaatcttcgccgtaggatggctggccttcgccggactcgatgaaggctgacatatggtcgaacagattttcgccgagctgcgcggccatgatggtggccacgaccatgacatcgccgatgccgtctttcacttcggcggtgttattctggatgtaggcttcgcaaacttctgcgaattcttctaccagcttgaggaactgatctttggccgaagagcctttgatcaggttgcggtctgaaccccattttaccaccaggtcatggagttcgctattcatgattcgttcgatgatcattctttcgattccttctgtatttgggatttgactgcgttgatgatggacgccgtgctctggcgcgatccgtccttagtggtgccgaagtaaaaggccataacagacttcagttcggcaaaccaatagccgatgatggtgccgatggcgacagaagaagtcggatccatcagcgcctcgcggccgaatgtgaaaattgcgatgatgatgaggatggaaccggtcagaagagcaaaagttatcgccgggcgaacgaagtcattttgttgcgcggcaagccttctcgccgaatccctgtctgccgcctcggcggcgaactggctgagttcggcttgtagctggttttgctcagactgaagacggttttgttcggcctggatggccagctcctggaggcgaacgcgctcggcgctctggagttctgcgaggcgcgctagagcctccggattcgcgtctagagcgctcgcgaccgaggctgggtcggccttcgaccctagcgccgtcgcgacgatagcgccaacggcggcgcctgcaggcccacccaggagcgaccccagggccggggcagccgcgccgatcttactacctatgtccttccagtccatgtttcgattcctcaaaagaaaggcgccattacagcgcctttctttggccgttgacgttagaactcttcggcttcagtggcgtcacccacgccaccggcgtcgccgcgaggctgttcctgcttgctgtagtccaccttcacctcaccgccgacgaacgacttgtaaaggtcggccgcagccttgaagtgatccgggttcttcaccaggccttccagttcgaactggacgccggaccagctccccttgtcgttcgacatgccgacggtggtcatgcggaccaggttggcgaaagtcggcggggtgcgcaggccctgcggggtctgaacctttttctgggacagcgcggtcatgagctttttcgaggccttgatctgcgaagacgacagggagatcagagcctggccgaaatcgccggtgtccggatcgatgacgatgacgtaatgaccacgggtgtcggcgaagtagtcagacttcttgtcgctgaccgaaccgtcttcgttcggcgcgtacaggcgcccttcgacttccttcaccttggtcgggtctttcatcatttccttgaagtcttcgacgctgatggcgcccttgaagccgccctcggcctcgcgaccggcccagcggatgaactcgcggcggtacgcggccggaatgatcagcaggccggtcttgccgtcgtaaatcttgccggtgacggtgttcaggaacatgccggccttcgcgccttcgatgtacttcgggtcatcttcatcgacctggggggacatcttctgcagaacctggatgaaggggatggcataggactcggcatcggcgccttcgaagcctgcgccgtcatacgatcccaaatccatgaagtcgggaacttcggtagtcgcgacggcgccgccaccggtggcaactgctacggccttggtttcttcggttgcttcggaagtttcggttttcttaccagccatgttaggctccttgtttgtcgaatttcagttatcgctaactgtgggtttataataacggaagttgcaactaagtaaagcaaattacatatcaagatttgctctttttcaccttcggtttcgtgatcttggcctctttgtattcgtgtacgccgatgaaatctggcagctcttcgcccttctccaggtactcgcgaccgaacgcctggagggtctggtaatggacatcgcggttgatggtggcgtcatagccggcttcgatgatggcctcggccgccttcttcgcatcttccatttcgccgcgaccgaattcggccagaaccttggtcttgatgatgccgtcgttgtcggtgtcttccagccacttccagaacttcgatttgttctcttccttgacggaaatgatggccttcggctctacttttaccgtgcggccatcagccagagtagtggtcttctggccgagttcctccagaagctcaggaatggtattgcgtttgagggttttcagctcttcttctttttcggccagcgccttttgcaagtcgaggatttcaccgtccagctgcgaagccttgtccaccaagtttagcagtcgatggccgatgtcggtggcttcgactgccatttcatccatgacgccgaaatagtcaatttcacccggcgcattctctttcagatactccggaacttccaattcttgctctttcatgtccgcctccaacttagtgatgttcccttacttgagctaagtattgagtagatattatgccgcatcttccttgatacggctactgatttacatattaaatttcgtcgcgagtgctaacgtcagcctcgaacactccatctacgacataactcgcaagattgcgcttccactccaggctgacctggattttctcgtcgatggaatccaaacagatcaggtcgaagtacaatacagagttgacggtgccgattcggtgatttcggtcttcggactgcattcgcagctcgttatcttcgtcggtcgtgtagtaaatggccacgtctgcggcggtgagcgtgatcccgattcccgctgcggccgggttgcccaggaatacctggacacgcttggcctgaaaatcgtcgatcagtttttctcgctcggcctctttggtatcgccgtaataggtcccaaacgaaattccttgcgtctcaagatacgcagcgatctggccgatttcctgaattcgcatggcccagatgatgatggatcgttctgggtcttcctccaacaggccctccagaagatcggtgaacaccgcgaatcgcgggttatcttcgggcggcaggatcaccggttcaccatagacgttgatatagccggacgccacttgcttgagcttcgaacgagcagccgcagcatcgaacgatacatccagcatgaaatcttcgttctggagaacaaagtgatagtcttcctcaacgcgctggtaaacctttcgttgctccggcgacatttcgaagtatatgcgcttgtacactttgtccggcaggaatgggagtgcttctttcttcgttacacggaaactgtgcggctcgatcagggaccgcagcttgtccaggttccggaataccgggcgcccacactcgtctttttcgaccagttgcggcggcatggtttgcttcccttccagcttgcgcatgatagcgatcattcgaggatcgtcactgggcaccaagacggaaaattcggccacaaacgcccgataggatttagtccccagaattccattccgcaagaattggaactgcatgaacaaatcggtcggtgcccgcgtcagaggagttccggaaaggatgcgacgggccacggccttctcgcccagctttacgatctttttcgcacgcttggcttgtgggtttttgatcctcgttgactcgtccacaattgcgcaaactttgaatgtatcaaggaatcgctcgacctcatcatagccagcctggtggttgattgcgtcaacgtttatggcgaagacgcgaagaactttttcatctgcgaacgtctcggcatacagacgatccaagcgcgctctggcctttttggaagtcggtcggccgcgccaatccacgctcaaagtcttgatcgcgacgtgggtgggaatctcgcgcagaatccagttggtgtggacgcctttgggggcgacgatgagcagcgcgtccacgcgcccctgtaggaagaggcgaacggcatcggccaaagtcgtccaagtcttcccggtgccctgctccatcaggtatgcgaaattccgtttgttcagggacgcggccagggcattgaactggtgctgcatggcctcggtcttcatgcccttgacgggatatgttttggctttcatttgttctccaaatcggcgaggaactgaacaatgttatccagtccttctgcatagctcgcaacttccaccaagtcgcggctgttaagctcgaacaaatcgagcatgggattcagcagcagccaatcggtcccgatcttggccaggacgaagccccggccgccccagccgatccgttcccgaaggaaagggatttgcccaggctcgaaacatctggccattgggcaggtggaagcgcgtttcggccactcctccaaagccttgaactcgacccagaactggacacctcgacgattcaggcagatcgaatcggacatgccagaccgccgcgtctccagaaagtcgatcaggattcggccgagcgagcgctgcttaaacgcattcgccgctttcgtttcgcgatcattcatcaccttcgccctctttggaaactttctctgcttgcgctgccagctttgctttttcgcgttcggtcaaaatccgcttgacggccttcacgatgaacatatcgattccgctgagcttccagcctttgatgaggaaccaagaacctgtcggcgtcccttcagcaatctgctttccgtattgcagatatttttcaggccgaattctgaaacgtatcggctgatcaaccgagtcatcaacgcacatgatgtcgagaaactgcgactggcccttgtacaccgggtttttcccttgatcggccctcttcttctggcgaatcggttcgttctcatcagacagaacttttttcaccatcttgacaatgaccagaccatcatctccatcgcggatatcccgaatgttccgaatggggtttccggaagttactccaaccagctccggattgtcataagcatgaccccagagcgtgtgagcttcgttcaaatctgcgaattgaacttcagaattcgacagactcgcggcgactttctcccaatcctgaagcgtcttcaggtgggtgcctgccagctctttatattgagccttcagctccttaagatcggccttcaactccttcagatcggccttcaacagtttctccagttctttgtcttggctgattttcgccgaaagaatctgggcttccagagctgctacatcagcagccttgtcctcaacatcctgtgccgatatcgggcaattggccagggcgatcctcgcggccttgacttcctcgcgaagacgcaggaaccgctcggccttcgccgggccgaagcctttggcgttcatgatgccgccgatcaagcgtccatccgccactacccagttaagttcggaatgctccgggtccagggccgtatattctacgccttccttggccaattcgcgaagtatggacacagtttgctggtcgtctttcgccgcccgaagacacgcggccgcgtattccaggcgatgatatcgcttcatgtagcaggtccagtacgtcaccacagcgtagctgaccgagtgggagcggttgaatccccaggcgccgaacgttaccatttcctgccaaacacggtgagcatcgtccggggcgacgcctatggtcttggcgccctcgatgaacaattcccggcgcttgttgaaaaattcttcgccctttcgcgcagacatggctttccgaatcgccgacgtttgttcccagtcgaactgcccaatgtccttcacaatggacatgatctgttcttggtacaggaaaactccatatgttccagacagatactgctcgacctgcgggatggtataggtcacaggctcgcgaccggccacgcgctcgatgtatttggtggccatgcccgaagacaacgggcctggacgggcgagcgccgttatgtggtcgatgttttcgaacgcggtgatattgatcgcattggcgaccgagcggacggcctggccttcgaactggaagatgccggacatcttgtcttcgttgagaatgtccagaaccgccttgtcgttcaacggcaagtcgtacagctcttgcgccgtcacgcaattagcatcttggatgacgcccagagttcgaagcccgagcgcatcgatcttgagaagattcagatattctgaatcgggcttgtcgagctgcgcgacaccttcagaagttaccgtgcagaagtcgatcacttcatcgttgcagaccaggatgcctgccgcgtggacgccggagtgggatgggtggatttcgaggtcgcccatgcaggcggacgcaatctcatacttttcacggaagtcgcggccgggctgagttttttcgaaagtatcctccaatccttttccatatcgttcgtccgccgatgtatattcgatgatcgagtttttgatgttgtcggtgtcgtggaatggaatgccgaagcgttttccgacgtgagcgataaccgacgcggccttgagtgtgttgatgttcccaagctttaccacgttccaagtgccgtatttctgctggagatattcgaacactaaatagcgatgggtatcggcaaagtcgatatctatatcgggaagatcggaacgggaaatgtcgataaagcgctggaagagaaggcgatgcgggagcgggtcaacctcggtaatgcccaggaggtagcagaccaaagagccggctgaagagccgcgagccgggccgaccagcatatgcttcttggcgaacgcaaccagatcggcgaccaccagaaagtagctgtcgaagtctttcagctgaatctgcttgatctcttcttggaatcgatcctcatactcctgggtccattccttgatgtggccgcgactgaggcggtaggcttgcccctcgcgagccagagcgacgatatcaccatccaagtggatcatcggcgccttcgccagtttcacatccgccaactgctcaactaccgcacgagtattggtgatggcggaatcgaactcttcgcgagtcataatgtggcgtaaacggctccacaactcctcttcggtggcgatgtggcgaaggccgaccgattcccgcaccttccaggccgacgcgaaatcagcatggtcgatggacggcatgtcgttgtaagaggtaattaccaccggctttccgaatgccctggccgtctccatagcgccgtgcgcggcgaccatcgacgcgggattgatgtcaatgtagtcgattccggccagatccagatgggcataggcctcgccagcgaatttgatgacgccgtcagcttcctggaattcttgcggagtcaatccttgattctggaccgacttggaagtcaagcggtagaacttctttgtgtccttggcgagcacccaggctttgagcttcagctctttctcgccatcgtcggcgcatttgatcgggatttccatgccgaatccgcgaggcagttctgccttggtagcggcttgttcccaacggacgtggccccatgttccatcatcgacgatggcgacgaatggggattcgatctctttggcgcgctcgatgatctccgggaatcgaccatatgcggcaccgtaggagtaaccagagcgaacgcggagctgagggaaagacatcatgcggcctccattgcttgatacgcccgatacactcccatgcgcttgcagacttcgtggagcagccgcacgtcgtcgagcgcccggtgtttctgtacatatgggccgcagtagtgctcataaagatgttgcagccgcatgcggtggccgaacaacggcgccgactcttccacagtacagatatcgagcgatgggaaattgacttcgtccaggccgaacttgccgcgagccagatcgcaggtcagcatgaacttatcgaatggcaggttgtgggcaatattcgcgtcggctctggaaaagaagtcgcgaactttctggcgctgatcgaggaaagatgggtgcttgatcaggtcttcgttcttcaacccggtgatcttggtgatgatttcctcgataacgattccaggattgcagatgaactctacttcatccaaaatcttttcgccatcagttatcacgccggcgaattcgatgattctcggctgctttctcagactcaccctttggtggaacgggagtcctgtggtctcagtatcccatacagcgaatatcatgtttgttccctcttatgtcgaaaggccggctgctttcgcgaccggcctgaggagtatatcgcgacggctgaagatttacgccttctgtccgtctttcggcgtgatgcggctggagcgcatggtggcgtgaacaaacgccgaatagttgatcaagtccaaggccgaatcggcatccttgaacccgctattcgccaggcgagtgagtttacccaccatgtgcatcacgaacagggcgagtcgatgatcatcggcggtcttcgccaccaggccgttcgggaagaggatttccatgatctttccgtacatcagatcattgcgaccataggtgctctggcgggcgcggaagacttctgctgcggcgtacagattgttgagaacatcttccgcgaaatcatcgggatgggaatcatcttcgcccggccagacggattccatggcgaacggcgcggcgtcttcggtcgggtcttcggactgagccgtttcagcgagcggagacggggctttcgcaaacgcctcgtcgagggtaggggcggagttcggggcggccgggaacggctcgcctgccatgtcgttgggcgcgctatcggggtcgctatcggccgcgacggcgaagaacggcgcatcgcaaccttccaggttcaggatgtaggagtcgatccccaggctattgtaggcatcgatgatgtcctggcgatcatcgaacgccgcgacgatcttggtgacgccttcgatcttcttcaagatgtcgagcgcgactgcccgcttgaactgaggcgccggctcggtgttaccatacggtcgcatgatgagctcatactcgcgatgctcggcgatgccgagttcgcggtgaatcttggccctggtctggaaaaagtggttgtcggttcggccggtgacgaagaaaatcatgaggtcggcgtcgatggcattcctgatgcgacctacagcgtgcgggttgagagtgtccttgtcgagacgagaatgatactcgtcccattgccgttccaaggcgaagctcttgcggtggctatcgttgaatacgcagccgtccaggtcgaagatgatgatgccattctttggtttgcgttccatattcagatttccttactggttgctttctgggtgacggttttatcgatgaacgtcccatcagaagtgaggcggaaaacttcgccattctggatgaaatcgaacgattgcacgttcatcgtgatgcgaatggattcgctgccgttggtcacttcgacttgtgcgatgtcgccaactttctcgacaatgatcttcatgttacatggacttcccgttgacggccacagggttggcctcttgtttttccgatccccagaaatcgcggcgcagttcttcctgctcggccgagcgatccatccatggacgatagaacttgcactgatagatcggtttcaccggcaactcaaccacaggaatctggccgggcttcgtctccagagcggacatgaagcggtcataggattgctcatgaatctcatcttcattcagaaccttcgatccatagcgcgggaaggcacaggagccagtagcgacacagtgcggctggagcagactatcgaacatcggatagacttccagaaccagtcggcgcatttcgcggaaggcttcctgatactccccttgcgtacgaacacacaggcgaactttcgccatgtcgctcagagtgcgcaaattgaacttggccgcgatcttcgtttccatgttggaaggaatgatggcacgagcatcctggagcgatgcgccggcctccaagagcttctggtaactggtctgcgcgtcggcgatggcatcgtgccacaggcggttcaactcttcgcgggcgtgataggtcgggtccggctcgccattggccgtagcctgctcatcgaaatcccagcggaatgcttccggctgaacaacggcgctaacctccagggcgcgactggtttcctgctggtaagcaccggtccgcgtccggacgagttggtgggtaaaattcttgcttacgccctcgatctggaaaatgaagtccacgaattcgaacggcgagcgaatggtgtccagcatgtacttccagtggtcgagcttttcggcttcggtcatggtcgccgggtcttggccgcgcatgcgggtggatttcgtccccaggaggagttcccaggcgttctgggtgtaactgatcagagaaatcttcatcagaaatcttccggaattggcgtgaaggtgaatttttctgtgagagcaagtgccaggccttgggcttgctccttacgaagtccatactgctccatctcttccttaagcagttcgcaggcctccagacgagactcatactcttcagcctcatgaactgacgagaagacggttccatcagaggttctgtatacgagttcaatagccatgatcgcctcagtagcagcggatgatttcggcgcggatatctcgacggtcgaggtagtgctcacgaatcttatcgcgggcgcgctcggcctcttctcgactgccgaacgacaggttgaacgaagtgaaaggcttatcgtccaggcgcccatcgccaatcaggtacaggatgcctaccagcacgaaagacggcgctgtctgtcgcgtttgcggcgggtcgatttgcatttctaggaaagacatgggaacctcttcaggatggtctggtgagtacatcaatagcgctcctgctgagcagctacggtttccggctcgtagatgagcatgtcaacgatttccggacactggcctttcacccagtcgatggccgcgaccagtgtggtggaagcggagaaagagaaagtgcggtaagactcatggatgtacggagaccccatagaatcgcgctcggtggtgcgcgaaatgactgctttgatattaatgatccggcccatcttcggcctccactttagcgattatatctgacaggcttaacttctcgccattcaggaataactggcgcgaaacttcctgtcgccctctggcccgacgattcgggccgttatggtgagactcccgccgccaagggcatcggtgtcccggaagaaagctagcagcgcccgcttgagcgctgcttcgcgaggatcgacggccattaacctaccacgttccagccgtgctgagcgcaccacacggcaccagcccctgcaggaaggctattcagaaggaacacaggagtcaggcggccgtcctcggtcatatggatgaagtagcgggcgccttcaccgagccactcggccttggcgatagcgcgttcgagattggccttggtggcgtaggttttggtgtggttcttgtcggtggagaaggttacttcgcgggccatttgtcgattccttttggttgaaggggttcgcgtttcgatgagggaatattacgcccacctgatccagaagtaaagcacttttgtaaattacttcacgaacattttcttggccttctgataagacgaagaagtcatcaggcgctcgatgacgtccatgtccgaaaccagatcatccagaaggacgttgcgccaggtagcgaaccggccgagcgagaagatgccagcctcatgggtgagattccagatcatggattcgcgctcgtcgcgaccgagcggaatgattttgcctttggtctggatggtcggctcgccatcttcgatgagctgtttccttctgatgccgaaggccgcgcaaacgtaatccatatcccagtcgctgtcccattcgatggtttcgattttaccatctaaagtctccactatccctttagtgatggattcgacgatcagagtatcaccggtgatggacgctcgaaacgttcccactttaggaccagggaaatacacggtctggaagacatcacaggggatggagagcttgtatcgactcacgatgatggaggttccttcaccgaatgacgggtcgattcccaggtccagccctgccgcagccagattggcgcggaacggcgcggtgctgatgatattcacgtggtcatcttgccggcgaagatactggaagaaagaggcgtcgaaaggacggctccaagtgatacgattcgcaagcttagccaccagctgctcatagtagtcggccggtgcgatccaacgcttttcagtcgccagattccagatggaccggtccgacaggccgcccgttactttcctggagtacatgttgcagtggtcgatgcgcggctgggaaatgaactcgccgtcgatgtagatagctttgtgtacagtgacttcgcggaacgggatgccggtgagttggccaatcactggcgagcggaatcgcagaagtgcgttgtggcgctccttgttctccggcgtcgccgcgtcgatgatttgggcttgaggaaagcgatgcgcggcgatcagtccggcgagtccggcacctacgatgattactttctgatcaggaatcatgatgtgtcccttatgagtgtacaaaacttgagaggataaaaaagggacccattttcatgagtcccttgaagagctagacgattcaggctcagaggagcggcggcttactcctcctcaccttcggaaccatcggcgccctgatcttcaccgccgtgctcctggccttcgtcatcggccttctcgtcatcgccctggccagcttcgtcttccttcgaagcgatggcaaccagatcgacccagcccatgatttccagcttgctcaggtagctgcggaccgaggtgccatagagaagatgggccaccttatcgccgaaggattcgatttcgaccggctcaccaacggtgcagtgctcgttgatgtatgcgaacaccttgccgcgagtcgagaaggcctgcggagtgccatggccgtcgccggtcgggatgaagtgagtggcgcgggggcgacgcgagccgttggacttcaggtcttcgcggcgggcttcggccttcttgcggcgctcttcctgctcttccttgcggcgctgcttctcggcttcgcgctcagccttcttctgctcggccaggcgcttgcgctcttcttcgcgagctactttctgagcttcctgggcggccttcttctcttcggcctttttggcgcgctcggcttccttctcggccttcttctgctcgcgctcggcttccttcgccttcgccttctcggcctgctcggcttccttcgccttggccttttcagcgcgctcggcttccttggctgcggccttttccttcgccttctcggcgcgctcggcttctttcttctcgcgctcggccttacgcttctcttcgcgctcagccttcttctgttcggcttccttggccttggcctcggccttctcggcgcgctcgcgctctttacgttgacgctcagcggccttctcggccttgcgcagggcggctgcttgttccttggtcagctcttcgccttgggtctgctcgttctggtctttctgttccatgttcttactccgggaatgtttaaatggatggcttattggcctgtgagaggattatctctaaactaattgaagaagggaatacctttcgcctgaacttctctaaatatttttctttcgggaaagtccagactccagggaacttatttatgttagcgaagtttttaactcttacgcaaaaacaacaagtattcaattgcgcgagttatgccagtatacatcaactggctgtaaggaattgaaggcaagttttcttccaacattgcgacccgcttccattccgatccctgcgacttgtggaacgtcatcgcccagccgaagtcgaatccgccaatggccttctgtgcctccagccgcacatcttcctcaaccgaaaagctaagaggattgaacttcacccagcgctcatagttcgtgccgataatgcgaactttggcaaacagcatttcatccggctcgtcatcatcttcttggccttcggggaccggcttgaagtccagcagaattgcttgctcgccgttcatgatgccatattcgtgctggttcccggtgcacaccagcttctcgccgatttccggttgtacacccttgtagccgaggatgcggcgcgccctggcgttcaaacggcggcgagtattgttgtaggcgcaaaggatcacgccatcatcgtccaagaacgtccgcatttcgtcgtccgacatgtcgaatccggcccgtaccagaatgtcgtcatactcgcggcagggtaggcgcttgccctggcggacgaacatcgacgcccgaacgatattgccggcgttgcgctcgatttcggtcatgatggtgtcacagctgttctcatggaaaatctggacgccgcgcacaggaggaacttggccaaagtcaccaatctccagaaccggaattcggtgcgacagcaagcgctcttcatcccactcgccgatcatggacgactcgtcgagcacgaccaacttcggcttctcgtcgagcgagtctttgttggcaaacatgatttcgccgtcttcatcttcaccaatcggccgatagatgaagctgtggagggtccgggcattggtgcaacccttctcgcgaagccgcgctgctgctttcccggttggcgcgacgaagactgtccagtccatcgagcagcaaagttcggcgattatcttcgcgatggaagtcttaccagttccggcgaaaccagcgagtcgatagacctggcggcggtgcgctcgatcacaccaaccgcgataccagtccacaacggaattgatcgcgtcgatctgctgactgtttggtcgaaagccgaatcgctcttcgatctgatcgacggtgaagttagatgctgacatatttgcgttctccaacgctaggtttaattgaatcgagactcagtttaagcacgccgtccacagaccatccagtatcacgacgatacttgcggccttgcggatcgacatagaagttcttcgtgcgccgcagcagaacataatgccaagcagctccaagcgcgtggacccttcctttatacgggaaagccttcgcctgctctgcggcctctttggccccagggagccagcggacggtcgaaaggaccaggatcgcacccttaatagcctgggaagcggcgcggccgtcctgtgggctassncbacgtthrtgaatcgagactcagtttaagcacgccgtccacagaccatccagtatcacgacgatacttgcggccttgcggatcgacatagaagttcttcgtgcgccgcagcagaacataatgccaagcagctccaagcgcgtggacccttcctttatacgggaaagccttcgcctgctctgcggcctctttggccccagggagccagcggacggtcgaaaggaccaggatcgcacccttaatagcctgggaagcggcgcggccgtcctgtgggctatagcgatgtctatcgaagtctacccagtggtggttgccgcgccggagcttgaccgttcgggatcgcccctcgaacaccaccgtgccttcgtgagtaaaaatatgttccgccatcgaatgttcctttataacgtacagttatgctttacctctgcgcaggaagagtatactatcagctgactcgccaaagcgagcgaatttaatccaactttacttcggcaggaaagtggccgatactagcgccgccgcctgtactgccctccaaaacagaggatacattaaatgcaagaatgcaagatttcccgcgaccaactcccggtcggtaatccgaatcccaatgtcgacaagactcgcgacccgaacctaaagcccggctacctgcgtcgcagtcgcgagctggacccggctctggccgttcgcattcgtcgcgagatgatccacgccgaagcatccgacttggccaaggccggatgggtcaattcacagtccagcctttatggatcgaaagccttcccgcgccatttcgtcgttcgcgtgaccggagttccggaagatggagctttcatcggcatgctgatcggcttcatcgagcatcgcgagcatggcgaatgggcggtcatggaagccggaacgaaagaaggcggcgccgtaatcatcccggtcgatcacatcatgcgagcgtcattcgccgaagccgaagagttcgccgaaaagtgggagcggaacttgggatggcgcctcctgcgccagctccgcgagtgcggcgccctggccgggactgaagacgagttcctgcggcggatcatcaatcgatacgttcgtgatcgcacgatcctcgaccaccacaaagtcggcgctgacaaaatctacactgatgcagtgctcaaaagcatcggcgaaacatggccgaaaattccttcgggtaaattcgtcggacaccgagtcgcgcagctcctgatcgatcacaaactgggtcgagcggggaccatcctgaatgacctggtggacttcctggagaagttcgcggccggacgcgataaagttatcaacatcgccatttgcaattgaggtgaatggaatgtataataaaccgacgctaaatcaccaacatcaaatcgtcccaaagttcgaaaagacagatgcgaatcggctagcagacgccattgaagaaatcgcccggctggaaaaggcactggccgaatccgaaaagcgcgggagcgaactggccgcgagctattgcgatggcgtgatcggcgatgaatacggccatcctcattgtcgttataaagtggagcgcgacgccgccctggccgaagtcgagcgcctgcgagaatcaaaaggcgatccctctggcagcttcgacagatgtatgaagatgatgtacgagcgagacgagaaagcaaaacagctagaagtcgccctggccaggatcgctgaatgcgaagcccaggctcagcacagcgtgccgggaaatgctgccgctctggtacgggccgaaggaaagaaatactcgctcaacgctgccggcatgcttgactccggcgccccggaacacgcccagacctttgccatcgttcagttgctgtccgagttcgatgacgaagaagcggaaagccactgggaagcgatcatggcctattccgattttcgcaccagtgacgctctgttccatgcagccgagctgctcgccgcccctgtagcccaggctcagcacaacgtgccggatgggtggaagctcgtaccgattgacccgacgccgcaaatgacattcgtcggccagtcgctgcgttatgactcggtaaacagcatcggcgagatttaccggcaaatgctcgccgtagcgccctcacccatcgatccggccgcgcaaccacagccgtgtccgcaaccacaggcccatcctgcccgctgcgggtgcgagcggtaagtgtcaagtaaggagttcatgtaatggaacagaagccttcaaaagtagatggggccatcaccatgaccgatatcgatattcacattcttcgaaaggcgaagcccgaagcgcaggacgagtgcgccgtgtccatgttagcagcagcgatccgccagaaactgcagcgctcccgcgataaaggccgaggcggctggatcgactgcgacgaagatattctgatcaacggattcgccgaacatgcgctgaaaggcaatgagaacaacctcctggacctggcgacgttcctgatgttcatgtgggtgcgcggcatcgatgatgcgaagattcccccggcgctcgaaaaggcgcggcagcacaagatcatggaagcctggagccgggtccacgaagatggcctaaactccgccagaaaggcgagtgctgcgcgacagtctgtggaagtgcctcgacgcaaggggcgcccggagagacttgcatgaagcctcacgaaataagactggcacaggccgaagagttcctgcgcgaactcggccgagggattccggacgacgaacgggtgatggtcggctacgctgaagaggccacagtccaaaccgacgagaacggtcgcaagctcaacgccggctggtggcctgtgccatggaaggaagggaaatacatcaactcccgatccaacgcctacgcatgtatctcgtcgtcaatcaagacgcctaacccgaagaccggccagatgcgatactggcgcggcgaagcctctttcggccacggcctggcgttgatggtcgatgacatcggctccggcaaagggtccaaaggcgacttcgaccgcgacgaattccgcgagcgactggagccgaccgcgattgtggagacttcgccgaacaactaccagttctggtatttcttcaaagagcctatgtcacacatgctccagttcaaggcgctgctctattcgttcgtggaccaggttctaaagaaaggcggcgacaacaccgtcaaggacgtcagccgttacggccggatgccattcggcttcaacaacaagcgcgggaaagacggcaagttcaaatatgccgacgaaaacggcaagccagaactcgtgcgcctgtacagcgccgactattccaagcgctactcgccggaagagattgcccaggcattcggcgtccgcatcatcatgccgcagatgaagaaggtggagataaaccgcgatgactgggtgtatgaccaagtatggctgaagtatgccgagcacatctgcacgaaatacaagatgggagaagcggcaggcggccaggtccagcagaatatgtccggcaaataccgcatccgctgtccctggggcgacgagcacaccaacggcgatcctttcggcgcatactttcgcggaccgatacctggcgccgagcacgaatatgtgttcggttgcgggcacgatacttgccgcaaagagcatcgacggacgtgggcggccttcactgatgaagtcgtcctgccgtatattgtcgaacaacttgaacgcatcaaccgccgtcacatcggcgaggagtagtaactatgcaaaatgatcctggaattctgattaccgccatcggctcattgcttctcggccttctcgtcttcttcgaaggcctgaatggatggaaaataccagtagcgaactttctcgcgtcgctcttgtgcttcttcgtcggcctttctgctttaacgtgctggttcgtcttggcgtttgacgtgttttagtcgacgaacggtccggaaattttcggatgggacggaacttattagctctgccggtttaggtaggagataatagccgtccctttcgcctcaatatgtagaggcagtgttatatccgatcatgtaaagcagaaggcggcaaacctaacatgattatcgacgacgataacattcttgatgatgacgaatcggggtccagtgagttcgatctcacacagatagaagatgctggaatggaccctttgatgaccgccgcaagcaaagcggccgacgatgcgattgcgaggaatgagacttaccgagcgcaaaaggcagcaaagtatgcagaggcgtatgcggaaccagatttgaagaagcgagcgcggttgttgatgctcgaccaggcgttcgatcttccggtcagccggctggtgaaaggaccgttcgacgacttcatcaccaagtacagctcgacttcagacagcaactacctcgcggtctatgatacgttgttctgtaagggcgacggaactgtcccacacccgcacttcgacgagtttcgcggccggctggtggaccaccgaggcgtggcgttcaacaacaaaaccctcgaccccattgacctgatgggcgccctcgcggctgcggccttggacgatccatcgatcaagaagacgattgagacttgctgcgtgtgggcgcgtcgatatcgccgcaactctttgatcgagacgtttgagaagaagataccggagtgggatggcgaagagcggattgacacgttactgatcgacttgttcaagccgttcgacaccgagcttaaccggatggtgagcaagtatttctggctgagcttgtactgccgcatcaactatcctggaatctcggcaccgatttcgttggcgttgattggtgggcaggatgcgggtaaatcctatttcggcctgctgatctgcaaggaactgtcgggcggtcgcgatctggctccagtccagctcgacctgagccggcatgaccagacgccattcctgcgcaacatcaccggcaactcggttattgcgaacgtcggcgaaatgtccggcttcaaaaagggcgatatggaacgcatcaaggagttcttggtgcgatcttcggatacattcgaccagaagtttgagccgggcgaaacgatcaagcggcaatggatcaccatcatggacggcaacggctacgatggactccagcgggacgactccggcaaccgacgtttctatccgatgttcgtatcacaactgcccgatgaagatggaaaaccgaactgggtcaagccgggagacggcaatgaaccattcaaggtggacttcaccgacttcggtcgcaagttctggcaagccatggccgagtgccgcgcctggatcgaagagcatggcgtcgatggatacctgaatatggtgtcggaagcgaaccgcgaagtgcagaacttctctatttcggaaatggagaatgcgcgcggtgtagttcgtgacgatacgattgatatgtatctgatcaacgtactgatcagttgcgagttcgaagagattaagccgggcaagaattccaagaatcctgggtggagagtcaacacagtcgaaattctgaaatggttcgatattctcgccagaaagaagccgatttctcgccacttaactccgcacctgaaggcattgggattcgtcccgaataagaatggcttgaatggctggtgcctgcctgtggataaggtttctcctggatggacgaagggtgtgcacacgacgttgccgccgttcaatgatgtgcttgtatacctgctgaggaaggtggattctgaggttactgatgaagccgccatgattcaaatccgcaaagtgaaagccgagcgcgcaaggatattgggcgaggatttctgatggagtgatggagtgtacttggactaggccgccttcgggcggtcttttctttggtgcggcgtacattcgatttcggttgtggccaagtgagattcggaagctatccggtaattaagttgggttggtgatggtgtattgtggaaagttcgtggacagtgaatcgaagattttggatggtgagtgggtgaattatggaaaatcgacgattctgactggatttttggggtcggccgcgtcgagcttaccggtaatttacgaaaccaggaattagggtcgagccttagtgccgcgtgggtttgaagggcttaaccggatgctttccggtttcggatgcagccgcaaaagtatactacagcgaaaatcgattgcacaatcctaatagaaaaaatctatcacggacgttacctatctttaaaattaattaaattaatagtaatttggtaatttggtatactttagtatttgaaagcctcgcggcactaagcttgtacatatcccgtcaagtttccgattcagctcaacgcgcggcagggtcgccggaaacttccgtacttccaaaccatgggcagcggcaacaccacggcggactaagcggcaaggtccaaaaccggacgagcggaaccggaaatttggccacgggacagaatcgctcatctggacatattcctaacattcgatttaacacccaatccaaacactcaccaccatcgtctcccgccaacagccgactcgaccctcacccaccagcggatcgcccgtataacatcctataacaccacctaacactcattcaccatcaaacccacccagacctacaggccacccacaagcagcccatagacgcgatccctggccccatagtacaatcgcgccatactcagtgtcgcggcagagcaccaggggccatccgccaaccaagccaccgcgacgactccagaatcgaactccagggacgcagcaccaaatgaccgccaaatcctacagacccgacgatttagtcacgccacaagaattcgctgatccgcagttcgcggcgatcaaccagaagcgtttcgatctgtacatcgacctgcgcgttcaaggctacagctcctggcgggtcttccgggcgatctggggcgaagagcacatggacgggccggcccaggctcgcatcttcgcgatggagtccaacccgtactatcgcaagcagttcaaagccaagctgaatgcgaccagaacgtccgatctgtggaatccaaagacggcacttcacgaacttctccagatggttcgcgatcccactgtcaaggactccagccgtctatcggccatcaaggaattgaacgttctggccgaaatcacgttcgttgacgagtctggtaagaccagggtcggtcgcggattggcagacttctacgcatcggaaaccgaggctcagactaccaccgttgctgccgcggccgaagccaatggctatgtacaggacggtaaagagggcgatttcccgtccccgacgccggaaccgaccgaggaagaccgcgccaaccccatttagacataaaataacatcgttctaggcctgaatcggaccgatctaaggcgacggtagcgggtaggggcgaaaaacgatcctagggctgttctaggaagccgaccaataacaatcagaaacgacaaagccccggactctagttcagaatccggggctttctttttgggtttcttattctccagcttcgatgatttcgaagttgtatttgacgccttcgtgctcgaaagtcatcttaccagccgccttcagctgcatacggaatcggatgcacttcgaggaaggcaaaccgaactcgatgaaggctgcgttgcaggatttgaactcgccgcgcttgcctttcacggtgaccgctacgccatgacgctcagtgcgcttgcgggcaacttctgggtctttccaggagttggcgatggctgctgacaggtctttggtctctttggttttctccggcgcgttcttcgcctcttcgcgcattttccggatttcttccagcgcttcctcttcggtgatttcttcttccggcttcagattctcttcctcggccttctcttcttccttcttcttcttggaagtgcgggttttgtagactttggccggggcttcctcttcctgaaaggcttcttcctcggccggcagagcattcaggatggcgaggcagcgacgctcagcagtcttgcggtcagagaaacgcttgacggtcgcatcggcgttgtgagcgttgtagaaggcgaccagttctttcatttctgcgttctggatgtcgccgaaggttttgatggagttggtcattttgcgatcctctgttttggaagatttcgttcgggcttcggtttgtcgccccgttgaaagagattatgcctaggtcgatgctgcgtgtctacatttatttcatcagattgatcgcaaagccgacgaacggttgtctgatgtgaaaacaccgcagagcaggttgcggtgtttggtgggcgagggcgatggtcagaaagtcgggactgtgatcggctcgattggcgggtcgccgggcctgtcgttgtccgatgcgggcgccgggctggaagggatcgcacccgaccgaagcgccagcgattccgactgcctgcttacctgcggagctggaggcgcttttggcgcatgaggcgcgggcggaaccggcaggcctggaggagccatcggcgccctgggcggctccggaagatcgggcagatcaggaagactcggcgctatgccgccaaaggaccgctgcgaccgctgcgacggattgtcgccgaacatttcggcggatcggttgtccttgatgacttgacctatggcagtcttgtcgccacccggttctgctggatcgaagcccgtgaatggagtggtaacgcagcgcatgttcggatgggtcggcagattgttcaggacgatggagtccgcccagacatacgggtttttgtggttgccgggtccgtggctgatgatctcggcaggaatatggccgttcatggtgagccattccgccatcccttgccgagtcagcgggcttaccacgatctgaccagtggactctttggcgatggcgaacagatcaccgaattcgaatccgatgattgtgtagttggacctggactcgccgacgaaagccagagtttcgatgttgtggtggatatcttggtcttcccagatgtacagcatggttcgctcctcaataaggttgcttttggtgttcgaccagagacataccggccggaactttgaagcggacgtattcgatcatcatcgccgttcgacgccgattcgtgcccgactcgtcattgacgaatagttcgcactggtgcggaatgactcgcgtcaccaggtcttcgcctttcgagccgtagaacttgatgtaggatgcgacgcctcgcgtcatgttcagacggatcgtttcgcagagtcgctgcgcggccgacgcgctagacagatcggtcggactgaccgtcacccagtaatggccactttgttctttatcggacataagctgccctccaatgagaaagcctctgcgactcggcagaggcttgttgttgttagtcgcgcttcaacagaacgactttgtcatatgcgcgatatttaccgcgccagtcttcccagtagtcgccggccgggcaggtaagctccagggtgatttcgtcgcgccagcattcgacagaaaggacaattgccttgttcctggctgcggaatccgccctgagcttaatcagaatttcgtcgccagttttcaactcatcaactcttacaacttttgccatggtgttctcctattgggcagcgccgcgagggcggatcgggtcgatgtcatgtaagcagatggtaggatagtccctggccaacttgagcttgaagtccacccagtcagcgccgatgagtgccgagacttcgatgcttactttgctgtgcggcgcagctccagatcgcaggactatggcccgacgccgaacgggatcgttgacgtcaacatgagtgagtatttcgtcgccgacgagcaactcacaggccatcaatattttggccatcatacaccctatgagaaggcgcggccaggacgatcccagccgcgccgatggattaacgtttgtgaaggatggacactgcgtccacgtcgaggatgctaatggtacggcgacggcgcggattgctgcgttcatggatgcgaatcaggttcgcagctggagctttgtccaccacccatacatcttccggcttctgcttccggagcaggaccgtcacttctgcgttctgggcgaggccgttgcagatgaaagtgaacttggacgagggagttctgtacatttcgagattcctttttggacttctggtccggcttctcagccggtgaagagattatgccctgattctcaccgccgagtaaagcatttgtgtaccaattctcccgtcaggtggaaccaaagtgcggtatcgcttatggctacgctaccgcgccatggcccttcttgctcgcacactgcgaaccacaggctgatttccatccttgccaggactcggccgaaagattcgaacctgcgccgactggacaggatgtcgacattcactcgtcgattgacctcataccggcgaccgttgatgacgaagaccagccgcagggtttgtccgtcaagacactcccagtatctggtttcatatcggagccaatagcgcttgccagccgggcctaccatggtcatttaatcgatgctcctggccgcgccacgcggtccggtcggcgggacgggatcgaaccgacccaggatgtagtcgggccggcgcgcttcctgaggacacacggcgagaaggcgccatcctgcgtccagggcagactggagttcgtccgtgcagcagtcttccttgagcagcagacggttgacgttctggagattcggaccaggtatggccgatcctgtgagtgagttccaaccctcgattccactcaccatctccggttggttgatgtagcttacggacataccggccaaccggctcgcggccagctccagacgctccagcatgggtcgcagagcagcttccgggtcaatgtcgtcccagagaaggaccaggctgatgatggtatacggatagtccttgtccagatcccaggctgaagcggtcaggcggcccaggccgatttcattacacataacgggaacgtcgttgctccaggtggacggctcccagttccgctcaccaggattcccgattgttacgccttccaggttccccaggagaacgtggagcttgctgacatattccgcctccaaggctttccgctcttcgtcggtctggttgtggcgatagaaggatggagggctgactttggcatggtagagtttcataactgttcctcggttttggaagatttgaaagttagagaatggtgtcgcagtatttctcgaaaggactctggcgcttcttctcgcagatcgcgcaggtgatttccaggtcgggcagctcgctgtaagtcttgccgagatacagccagcgcttgcacagactgcggccgtccgacgtgaagaagtggactttgcgagcattgccgggttgcgcccagccgcttggtgccggcttcctgctcataccatcaccacgtcaatttcgtcggcgaagaagttaaagccaactccatctgcgtagccagtgtaacgcagacgagtcgtcccatcaatgtgggcttcctcgacgccgatgacttccagggtggtatcgttgcagtacagcttgacgaacatcttgatgccggagccaatcgccgcgaaggcgatctgcttgtacaggtcttgcttgatcatgctttacgctcctgtttgcggatgtattctgccctgacttcggcttcgaacttcgcccagagcgcgttgtctactggaccccagggaccggtctgagttccgtccaccggcgcgaacttgccaccggcgcgacgatacttggacagcgttctcaggctgatgattttctcttcttgggaatcgaattggacgatcacttgacatacttcccgaagtagcaggtgtggagtatttccaggcctttggagatagccttcagcttgatgccgaaattcttgatcgcccagtccagatcgtggtgatagaactcgatgatgttgacgatttgaccggcgctgtagtggatgacgcgaaccttgccgttccagcggaaatcttcgcggctgtttacggcctcgactgcgatggtgtcgtttctgccgatgttccatttggagctagtcatgtcgcaatcctctttttggagtgtttcgcgttcgatgaggtaactatacctcagccacctcatcgagtaaagcattttcttcagattatctgaaaccttttgaagacaggaattgccgccagagccagtcgatgtgttcgttgcagtaacgctcgccatcggacgacatagataaggcgccatcattgatgccgaagtgggccgcagcgagacattcgaactcgaactggagcgttcctgggcgagggatatgggacatggcgtatttctgcacggtcagtgatcctcagaaggtttagcgtttgcgatagccgctactttctgcataccgaggcgatagaaatcggcttctttcctggcttttgtaagctgctccatggcgtcgcacgccgtcttgtgctgggcattggcgttcttgatgctgccttccaggctcttgtccagctcttcccggagcgccttctgcgatgctagctctgcctccaaatcctggattctgagctggagctggcgatttgtctcgccaacctggttttcgcgggcgatggagttctgaaggcattcgtcaaggcgagtattttcgcgcaccagctgatgcttttcgactttcgcctttctgcacgtctctcgcatttctgaaagctcaatcgcatgcagatcgtcatccgggtctttacgctcttccttcgactccatccgcaggtagtactggccggctgcgaaggcgagcactgcctggtcggcatacgctgcggcatcggtcatgtatctggatttgtagcgaggcagaaacttgcactcctctggatcccagaggagactatcggcaataggccagaatttgcggaagccatcaggatcgacttctacattgaccatttgcagctggccggcctccacttcgacttccagaggaacctgaatggcgccggtgatgtactggaagtacactatgctagacataacacaatcctcataagaagtcgcggccgggaccatcccagccgcatcgtaatcactcttcgccttcgtccgcgctcagccactcttcgaaggcgaaatttaccttagactcgacccaatcttgaagctcatcggcgaactcgtcactgtcgatgtccatcggaatgcccagagtctcttcgttccacagttcggcattcagttcgaactggatagccggttcgccatccacattcagcaggatgcggtctgcgacttcatattcgtcgacatcgaagaggaaaccgccgctgatgatgtgctggatgaaagcttcgtcgaagttgctgacgccgatattgatctgcttagtcatttttttctggccccttatttggcgagtttgtactgagctttgagggtggtcagcttagctttcagggcgatcatagcctggccgcgcaggccttccatttctgcctcgctgatggcgatcttggcggagcggatttgatcgttgatctgggatttggtcatttctgcgttcctctgttttggagtgtttcgcgttcgatgaagagattatgacgctattcagaatggaagtaaagcagaattgtgaaatatttctcaaagtggacgaacggtatgccccgtcaggaatatttcctcccatggaaggcatttccgcatccgaatgttgattaggtatcccaaagcgcgcagtggcgaatgtgagtccgcacgtacatagggttgtattgtgcgaagtgctcgacggtcgcatccaaggctctgctattgccgcacccttccgctttgcgagccaggaagaatgcttctatttgctggtttgcgttcatcgtcttaccctccaggtgttt

SEQ ID NO: 9 - DNA, 45341 bp, artificial sequence
  BP1649
  misc_feature (19687)..(19688): n is a, c, g, or t
atattccccagatacaccggaggataaaatagacttttggggtatccccggttataggccctggatcaaaggcacccttcgataactgttggtatattactggataaaggggcaatagaccagggcatagagaacagaggtagccctaaggtatacctatagaacctggatcaagggaaccctatgccacttaccccttaccagcaacctacgaagggtagtcttagggtatatctatagaaccctatcataccgttcgtcgggtaaatcaggtgattatcaaagaaatatcaaaaagtacttgacaaggtatccaaaatgtagtataatagacctataggctcttaagattccttcttccttttgacttacttactaagaaggttagttaccttaaggttatcttaagatagtcttaagaacccctttcccattccagcaaaaaccctaacaaaaccgggccttgcgactaaaataaaaaaaaagaagaaaaaagacttgacaaaatagaaaaagtgtgatataatagtattataaggttgagaaattaccttaagatttcattgggatgtagctcagttggtagagcagggagctgttaactctcaggtcgcaggttcgagccctgccgtcccagccaacagaggtcgttgtagaggtagatggctactaccatccggctgtaacccggacgccattggctagaggttcaattccttccttcgaccaccattaactcctcgtagctcagttggttagagtgcctgtcttggacacaggaggtcgtaggttcgagtcctaccggggtgaccatttagagagatcggagcagtgtatgtcagacgaaaaggttgtctcgattggggctgctcctctttctgctaaagaaaagctagacctctattgtgaggctctgcggatggtatgaataagacccaagctatatagccgctgggttctctcctaatcatgcgcaacgcaacgtagctgcataccatcgaaagcatgccgatatatcaacgcctttatctctgagcgcatcgggagtcatgtccccatggcgcttcgtgtggttgtagagattgctagcaacccagaagagaaaggtgggattcgcctcaaggcagcccaggatatcctggatcgtggaggcttcggagctaagcagaaactggagcttactactaagaatgtggaagatatgtccgcagaggatctaatcagtgaagttcgacgaattctcgacgaagagccagagttggctaaagtcatttctttcccaacctcttaagtaccttgatctaatcaagcgaagagaggggttggtactaaagtggtacaaagactccctcgggaagataactggcggttatggccacttgcaactccctggggaagacggaccgattaccctagcacgagcagagacttggctagagaaagatagtaaggcagcctatgatgcagcccaagggcaagtatctcagctgcctttttgcactccagagctattcgatgccctcgttagcgtcaacttccagctgggtacagcgtggacgaagaagttccccaagacgtggaatcttctgaaatccggaaggtttgatgaggctgcatgggaggcagaagatagcctctgggctaaacaaactccagtgcgcgtaagggacctccaacgggccctgtggcgtgcatcaacagtaggtgacaaggtggtctaatggatacccaagagcggctacggaatctagtcagggagttggcggagcggcagaagtatttccgcatgaaccagtacactccttatgggtggcaagagaagtttatcgcagcttcctcgaactgcgcccagttactggctatgactggtaaccgctgtggtaaaacctacaccggggcctttatcatggcctgccacctcaccggtcgctaccctgagtggtggactggtagaaagtatgatcgtccagtgaactgctgggcggcggggatctccacggataccactcgggatattctccagtccgaactcctaggagactggaagaaccctgaggcttttggaacggggatgatccccaaggaagatatcgtagagacgattcgtagggaaggtaaacccggatgtgtgcaagcagtagttgttaagcatacctccgggggcctctcgtccctcatcttcaagtcctacgaaatgtcccaggacaaattcatgggtactgccatcgacgtcatctggctcgatgaggaatgccccaaagatatttatacccagtgtgtaacccgaacggctactactgggggtattgtatatctgacgtttaccccagagcatggcctcacggagatcgtgaaggacttcctccaggatcttaaacctggtcagttccttgtccatgcaagctgggaagacgccccacacctcagtccagaagttaaagagcagctactctcggtatactctccagcagaacgcaggatgagggccgagggtgttcctatgctcggatctggtgtagtcttccccattctggaagagaagtttgtatgtgagcctttccagatccctgaccacttccataggatcatcggtatcgacctcgggtttgaccaccctaacgctatcgcctgtgttgcttgggatcctgagaaagacaagtattacctctatgatgagaggagtgagagtggtgagacccttgggatgcacgctgatgctatctacctgaagggtggtcaccagatcccggtagttgtcccccacgatgcctttaagcacgatggagcaacctctggtcgtagattcgtagaccttcttaaagatgaccacaacctcaatgtagtgtatgaaccgttcagcaacccaccgggtcctgatggtaaacacggaggtaactctgtagaattcggtgttaactggatgttgacccgtatggagaatggtgatctgaaggtgtttaatacgtgtacgaacttcctaaaagaaatgaaaatgtaccaccgaaaggacggaaagattatcgacagaaacgacgatatgatctccgctacccggtatgccctgttgatggcttcccggcatgcacgtcctggtgctgtacgaaacagtggatactacaggagtgatactgcaaagttgacccctgattggtttgggagtattgtctaatggctaagcgtcgtcgcaagattaagcctatggatgatgaacaggtacttcgtcatctagaccaacttgttaacgacgcccttgatttcaactcttcggaactttccaagcagcgttctgaggccctgaagtattacttcggagagcccttcggtaacgagcgccctgggaagtccgcgattgtatctagggacgttcaagagactgtagactggattatgccttctcttatgaaggtattcacgtcaggcggtcaagtagttaagtatgaacctcagactgccgaagatgttgaacaggcagagcaagagactgagtatgtgaactacctcttcatgcgtaagaacgaggggttcaaggtaatgttcgactggttccaagacactctgatgatgaagaccggtgttgtaaaggtctatgtagaagaggtcctgaaccctaccttcgaacgattctctggtctctctgaggaaatggtagcggatatcctggctgatccagacactgagattctagcacagagtgtggacgaggatggaacctacagtattaaaattcgcaaggacaagaagaagcgagagattaaagtcacctgtatcaagcctgagaacttcctggttgatcggttggctacctgtattgatgatgcacgcttcctctgtcaccgtgagaagtataccgtaagtgacctgcggctcttgggtgttcccgaggatgtactagatgagcttccatacgatgagtatgaattctctgatagtcagccagaaaggttggtacgtgataacttcgatatgactggccaactccagtacaactctggggatgatgctgaagccaaccgtgaggtatgggcctctgagtgctacacccttcttgacgtagatggggatggtatctctgagttgcgccgtatcctgtacgttggtgactacattatcagcaacgagccttgggattgccgtcccttcgctgacctgaatgcctatcgaattgcccataagttccacgggatgagtgtctacgataagatccgagacattcaagagatccgttcggttctcatgcgcaacatcatggacaacatctaccggactaaccaagggcgctctgtagtcctggatggtcaggttaacctcgaagacttgctgaccaacgaggcagcgggtatcgttagggttaaggccatgaactctatcatgcctctggagacccctcagctgtctggggaagtctacggtatgctagataggctagaggcggataggggtaagcggacaggtatcactgaccgtacccgaggactagaccaaaacaccctacactctaaccaagcggctatgagtgttaaccagttgatgactgctgctgagcaacagattgacctgattgcccgtatgtttgcagagactggtgttaagcgtttgttccaacttctgcatgaccatgccatcaagtaccagaaccaggaagaggtcttccagctacgaggcaagtgggttgctattaaccctgccaactggcgagagagatccgacctgacggttaccgttggtatcggcaacatgaacaaagaccagcagatgctccacctgatgcgtatctgggaaatggcccaggctgtagtcgggggtggaggtctcggggtccttgtctctgagcagaatctttacaacatccttaaggaagtcacagagaacgctgggtacaaagacccggatcgcttctggactaacccggattctcctgaagctcaacgggctaaggccatcagagagcagaaggaagcacaacctaagcctgaagatatcaaagcccaagctgatgcccaacgtgcccaatcggatgctatggctaagcaagcggaggcccagatgaagcaggtagaggctcagatccgactggctgagatcgaactgaagaagcaagaggctgtccttcagcagagagaaatggcccttaaggaagcggaactacaacttgagcgtgatcgtttcacttgggaacgggctcgtaacgaagcggagtatcatcttgaggcaactcaggctcgggctgcttatatcggagacggtaaggtacctgagactaagaagccctcgaaggcagtgaggaaataatcttgggagaacgttttggctatagtctagtgctgactgatgcggcacaacagatggtacgtgagaacgttcttcctgagcttttccgtattgtccaagaagagatcgagggagagtggaagtccacggcacctaaggattcagagtccagggaggccatctaccacgaactacatgccctcaaccgcgtacaacttcgtattcaggctatcctggattcgatcactctaaaggagtataagtaatggaccttgagaatcaaggcatggatgaattcgaggcagcggaagccttcggagatttgctcggtgatgacctcctggcccccggtgatgaaaccgtagatggtaaagtcgtaggggaagaagaggaggaagaggtagtagatgaaggtactccagaggacaccgaagaggttgagtccgaggaggaaccagaagaaggttctgaggaagaccccgaggttgagtccgaggaagatcctgaggataaactctttgagatcccgattggggatgaagtctacgaggttaacttcgaagagcttaagagtggctaccttcgcaatgaagagtttgtaactcgacaagctgaactagaggatcagtatgcagctaaattcgaagagcttgatgctgaacgctctaatctactggccgagcttgagcagtatgctgttaccgctattgctggtgctaatcagtatgacaatgtaaactgggagcagcttaaggcccaggacccagagaagtatcaaacccttcgactggaagccctggaagcccgagaccgagcccaggctcttatcaaacgtcgtaacgacattaaggctatgcaagagaagcgagccgagattgtccactctgcctacgttaagcgtcagacagagctagccaagaaacttatcccggaaatgactacggatgagtcttggggtgacaagatcgtgtcttacggcaaatcgattggatactccgaggatgagatccgagggatatctgatgcccgccaactggctgtactcgatgcagcacgtaagtgggctgaatctcaggtccgtcgcaaggctgccctagagaagaaggaggagactgaactacctgccgcagttaagcctgctgctcgtagggcggaagcctcagagggttctaagcgggttaaagctgcccgcgctaatctgaggaaagaccagtcggttgaagccgctgctgctctcttctcctctctcgacattttctaatagaaggaagtacattatatggcaactccaactaatgccgtctccactgtagagatcaacggtaagcgcgaagaccttatcgatatcatctacaacatcgcaccctatgacaccccgttcatgactgctatcggcaagggcgtagctaccgctatcacccacgagtggcagactgatgaactccgccagccgggtaagaacacccgagtggaaggtgaggatgcaaccatcaaggctggtagcttcaccaccatgttgaacaactactgccaaatctcggacgagaccctgcaagtcaccggtaccgcagataaggtcaagaaggctggtcgtaagaacgaactggcgtatcagctggctaagaagtcgaaggaactgaagctggacatggaatacgccatggtcggtgcccctcaggctaagatccagcgtaacaccactactccgggtcagatggcaaacatctttgcctactacaagaccaacggttcggtaggtgctaacggtaccctgccaactggtgatggttccgacactggtaccgctggtgacctccgtcttctgaccgaagacatgctcctgaatgcctctgaggccatctggcgcaacggtggtcaggctaactcgatccagacttcgagctcgatcaagaaggccatcagcaagaacatgaagggtcgtgcaactgagatcaccctggatgcctcggacaaccgcattgcgcagaccgtggacgtctacgagagtgacttcggtaagtacaccattcgtgccaaccgctggttccacgaaaacaccatgttcatctttgatccgaagatgcacgccctctgctacctgcgtccgttcttccagcatgaactggctaagaccggtgacagcgagaagcgccaactgctggttgagtacaccctgcgtgtaaacaacgagaagtccggtgctctgatccgcgacgttgtagcccaggtctaacccaacggggcccttcggggccctttgtttccccttaggaggtacatcatgagtatccaatcgacttatgcaattgacgaagaccttgggctctttatccgaaaggatactcaagatgttgagtcaatcctgtccgctaacgccgaagagcgccactcgggtgtcaacagtaaccgaaaggataatatgcgcaaggtagcaagtatccccctggttgttgtagaggccctacggaatcgccccatgtctgaaggtggtcccatcgatcttaacctgatcggttgtgacccagaccatgccgcaagatttacccgttggcttaatgaccgagataactatcggatgcggacctctgaggcacgggtgtaatgaatggctacgatcaacaacgtaactgatctcgctatcgccgctatccagtggtctgaccgtcaggatcttacccaagaacttctgatgttgttcattggtaataccactgaccgtcttaaccgattgctacgggtgagggagaacgaatacttcgaaaccctaatggccttcggtggtggcattgagatacctgagcactttgttgctctacgatctatcacgggtgactcccttatcggtggacgtactcttcagtacatcacccaggataccttcacccattatgttaactacaactaccaacctcagggtgtaacctactacactcggttgggtaacttctggagagtattccccgttgttcctgacggtgccccgttcattgtgaactactggactgtactcccagagctaagcctcgctaacccaacgacttgggctctgacgaagtatccgcagatttatctctatggtgtccttgagcagatttatctgtacaccatggatgaagctcggtcccagttctggggtcagaaactcgaacgggctgttatggaactccagaacgaggagaatgccgctgacttcgctagcactcgactggcgatcaaagacattgaacgttaaggagattcagatgcctatctttctaaaaaccctcgcaatcaaccttctggctaccctcttcccaaccaaggtaatcgctaagtccatcgtgactggtgctaaggctctggcggagaagactaactctaaggttgacgacgagttcgtaaaagtcctggaagacaaccttaaggagaagacggaggatgcaacttctaactgataacctgggcagcatcgtcagtgccctggtcgtatcctcggtagtgacggtaggttcctcggttgtcggtcagaatgttaatcaggctctgcttgaaagaaacatccaggccacggagaagctcacccaagcggtgagcgatctccagatttctatggcaatctttggggagcggtatgtcacccgaaaagaaatgaaagaagagataaaggaggccaagaatgggtcttgaggtcgcaacttacattaaccagttggtgcctacgaaccctaccggctctgatctgaaatcctttggggatgaccacctgcgtctcattaagagtgctattaagaacaccttccccaatatttctcaggctgtcactgtaacggcagcccagctaaacgcagtcgctgatacaacccagtatgttaaacctgggatggttatcatgtgggctgggtcactagctcagatcccagcaggttggaagttgtgcaatggggtaggtactacctctaacgggattcccgtccctaacctgattggtgcattcccttggggtatcgatggttcttcccaggctgtagggactagaggtggtagcgctaacatcgtatgggatgggttcactgaagggactgcccttaccctagcccaaatcccatcgcacacccacacttggagatcccgaggggctactaccctcaccggttctgcgggtgactctggtgctctgacgggtggctctggtaacgcagccaataccaaccttgagactggccctgctggtcaaggtcagactcacaaccatgcagtaaagatcaacatgccgttgggtaatatcccaccgttctgttctgtgttcttcatcattaagaactgaggtatacaatggccctagagagacaagaggtcaagaaccctacggggattgtgaccgatatcgcccccgctgacctgccactggagaaatggtccttcgggaacaacgtccggtttaagaacggcaaggctcagaaggctctgggccatacgcctatctttgatacagcccaggccccaatcttggatatgtttcctttcatccggaataacatcccctattggctcctgtgttctgaacaacggttgtatctagccgacgggactacaatcatcgatgtatccccaggaccttacgctgctagtataactaacagatggtctgtaggatcgttcaacggggtaatctttgctaacgatggggttaaccctcctcatcatcttccaccgtcagaatcaacctttagggtgctccctaacttcccagcgaatactacttttaagaggcttaagtcttttaagaacttcctggttggcttaaacgctacaagtaactctgtagaaatgccacagatggtctggtggagtacctcggctgatgctggtggtgtacctgcatcttgggacccaacggaccccactaaagatgctggtcagaacaccttggctgataccaatggtgctatcgtggatggtgtgaagcttcgtgactctttcatcatctacaaggaagactctgtatactccatgcggtatatcggtggattgttcatcttccagttccagcagctgtttaacgacgtaggtatcctcggacccaactgtgcaatagagttcgatggtaaccactttgtagtaggccacggtgacgtatatgtccacaacggtgtgcagaagcagtctgttattgatgctcaggtccgtaagttcttcttctcggatattaaccctgacaactatcaacggaccttcgtaattgcagaccacgtgaatactgaaatgtgggtatgctactcttccactaggtctgagccaggtaagcactgcgacagggctatcatctggaactggaaggaaaacacttggagtatccgagaccttcccaacgttctcagtggagcctacgggatcatcgatcctaaggtgtctaacctctgggatgacgaccccaacccctgggataccgatacttcggtctggggtgaaggctcttataacccagcaaagtccagtatgatcttctcgtctttccaggataagaagttgttcctcttcggtaataactctaaattctctgggcagaacttcgttagtacccttgagagatccgatatctatcttggggatgaccgaatgatgaagactgtgagtgctatcatcccgcatatcacgggtaacggcacctgcaacatctgggttggtaatgctcaggtacaaggttctggtattcggtggaagggcccctacccataccggattggccaggactataagattgacactaaacatgtgggccggtacatagccttgaagttcgacttctcctcagagggtgactggtacttcaacggatacactattgaaatggccccgaaggcaggtatgcgatgagtcaaaagtacagcccttcgattccaccacaggaagaggaggaactgctgcccttccttaatgaagaattcgttagggttggacagactcttaatgacctagctgacggctactggggggtctctatggagccccctaagaagctcaagccagggactgtaaagtattttgcccccggagtggtaggtccagtatccggcatctatcattacgacttggataaccaatggagactcgcaggtactaaacccaaggacctgccgggggattttatcctatttaccccacagaacaaccatcagccgatgggtacctgtgcctataggatgaacactgctaaggatgaagtatggataaccatgctcatgtctggtggtaactacactaatggagctactgtcctggatcttccccaggcgtattggcctcctgctgagttgtttatcccggcctattccagcatcatcccagcgcagagcactattacttatccacctccgtctgaccctaacgcacctccgttggatcaagtctttgatgttctcaacagggctactattcagactggggtggttaaccaagcaatgtttaagatcacagctaatggccgtgttctaatccaaggaattccccaaggagcagtcttcgggggtacattcacattccccctggtggtgactccatgattcatttgattactcgtgagaatatcgatctgcttcctaccgtagtccctgctctggcccgagccttcaacaggacggaccttggtaagttttgggacttcgaacacttggttcactctttggttaattatgaggcctatgtcttctaccaggaagagagtggctacgctggtgtaattcaagtgtcccaagcacccctgggtaacatccttcacttcttctggagtggtaagatgcctgggaatgaaaccccggtagattactcggaggtagacgacttcctcggacagttcgcccaacgagttaactgtcggtttatccaatgcgaaggtcgtcggggctggaagcctaccctagagaaactcgggtataccgaagactccgtatccttctatcgtgaggtaactccagatgaacttcctccaatttaatgtaaagcgtctgatggggttcgatgtagaggatgccctagattctcgggcttacaagggtggtagtaagaagcaaaagaccacctctgtctctacaccctatcagcaaggtaactacaatgaactactctcgggtgccagtgattggctacataacgggggctttgaccctaactacggtggcgatccgaacttcgacccggtggctgaccaaaatgctctccagcttagtggcatcgaagggttgggtggtctcgggggtgcccttcagtctctcctgggtagctcaggtgttagctctctggctgattaccttggtccttacgatcccaacaaaactggcttggcgaacgccattggtgcagccaacgagcagatgcaatgggacttcgacactacggtacgtccagacctgcgagcaggggccactaatgctggtcagtatgggagttcccgagcgggtgtagcagaaggtattgctaccgctaggttgctccagaatcaacagaataacgcctcccagttggctttccaagaccagcaggcttacaaccagaataggttgaataccctgggtaacctgtcggctattgctaagggcctcggctctggtaatgccatgcaggtagatgctggtagcatgcttcagaaccaggagcagcaggaaatcaacggggctctacagaagtgggcctatgagaataacgtcagcctcaacgacctcctcgcctataaggagcttatctccggcgatatgggggggaccaatgtcactacttcttcgggtggtggcagtggtggtggcctcgggtctgccctgggtgctctcggtggtgcttccttgggtgctctcttcggtggcccagctggtgcttctgttggtatgaacgcaggtggtagggtagggggccttctgttctaatggcctcccttcctcagaagctgttcgctataggacagaatataggtggtgggcaggagcgggtacagttgagccgtcaaggcccctaccgccccacccaccttgggacaatgcaatcgggagagtctagtggacaatcaaacccttttggcgcaatgggcggagcagcactcgcggctctcctcgggaaaggaagtgagccttcttcagaaacagtaccaagcttttctgtcgagggggctagaggagcaagcgaacgaggcgcagcggaagttgcagcaggtatgggagcgggagtgggaatccttcctagcgcagaagaactcggtttcggacagcagccaaagtctggaatcctaagtaaactatttggaggttaatcctatggccagcatggcttatgaagggtccccaattcgccctagcatcctccgggctgctcagaatgaactggacatggcgcgaatcgcaaggaacaaactgccgctggctgtagagggctcaggtattcctgatcgtgtccgtcgtgctgctcaggcagccctggagaacccagagcgttggtcccgtgcagcccaagaggttgcacctgcggctgaagctactggtcgcggtgccttgggtcgtatcgcaggtatcctcggtggtcctatctctgtaggtgtacaagccgctgtaaccccaggagaactcggggatgcagagcgtactcgtgcagaagaaatggctcaggctagccaagcggttgagaacatgggtcccgaggttgctcaagaggctaaccaatgggcccagggtgtaggccaacgcgcagcccagaactccacaggaggccctacgggggccggtctgttgtcctatggggtaacccctaaccaaccctctatcgagcctgagatcaccccagaggtggcttccgaggctggtgctgctgtagcagatgaggaggaggctaatcgccaggtcatccaacagggtgcagccgagggtcttcgtactggtgctgtaagtcgtcctgaaatggcccaggctgtagttgaagctgatgcccagagagagggtgtagagcttaaaccccaagagcttaagaaccgggtgaacgaagagttgacccagatgaggactatggacaatgatgacctgtctcgttatgtatcttacgctctcattggtactggtcttctggcttcggccctagacaagactggtaaagctgggggtatgttcgctgcttcctatgagcgtcaactggatcgtaacctacaggctgggatcaaccagcagaagatggctgccgcagctgctgatcgtcagatcaaggaaaaggatctggagcgtaaggtggctaaggatgctgctgatgtacgccttggggagggcaacctgaaagttaaggaagggacccttgagcaaaccaagcgtaagactgagggcgtccttgataagtgggtcaaccaagctgctgtagatagggctaatctggagttgacccgacgtggacaggatctagctaatcaacgggctcagctacaggctgaaacaacccgtcgtggccaggatatgtctcaagagaatgcccagcttagttctgctgtacgcctcaaaactgctaagatcagcgctcaggcacgtcaagcggcagctaaggcagcccgaggtgaagctgttactactaaggacgcccttggtatcctgagtgaagtcaatggttctcaggctctgggtggtaagaagctgagtaagactgcccaacaggctattgcccagactgtccgaaatgaacttcgggctaatccgggggctaacccagtgggtattatccagcgggaggctgctaagcttcaacctacgggtaactggtttagtgctgatctggactatcctgccccaacccgataaaaggtacttgacaaagtatccaaaatgtagtataatagacctataggctcttaagattccttcttccttttgacttacttactaagaaggttagtatcctaagatacatcttaagagcctattctctttccagcaactagaaggtgacttatggctctttctccagaactgaaggccgctattgatgcggaactggctgaggtcaagggcctcgacgtagccgctgaattggcttccttgaatgagccagaggttatcgaagaggcaccccaggaagtagcccctactacccctgagcctgccccagacctgagtgccctagtaactccggctgaccctaattctattagctctgcgattggtcgtggggttgataccatgcagtctaacatcggtggtactattgctacccttggtgaactgactggcagtgactacctgaaagactacggcacacagatggccgaggagaatgctcaggaagcgtcacagtacggaacccctgatgttcggtctttcgctgatatccaagatatcccatccatcggttcgttcctaaagaataacattgtagaggctctcccttcgatggcccctgtacttgctggtggtgccgcaggtgctaaggctggctctgtctttggggccccaggtcgtatgggtggagcgctcattggttccttcctgagttccatgggtatcaacgtaggtgccctgagtaaccagatgaaggaactagaccccgatcaaagcaacccatggaccgcagtcctcggtggtgctggcctctcggtactagacactgcgggtgctggtgttatcgctgccccactcctcaagcacatcggtaaagatggcgcttaccagatgttggtccaatcgggactacctaagcaaaccgctatcgaggctgttacccaggctggtaagcatgcagcagtctctggtgtagccgagggtgtaacctctggtgctcaacaggcgctccaggataccattgcctatgatgcagtagggcaggtacaaaccccagagcagttcatggataacctcctgacggctgccttcactggtacagctatgggtactgccggtggtgctgtatcctcgggattggacaccctgggacgtaatcaggactcagctgggtctgccgtagttgatcctaacgcccctgcggcccctcctaaggcttctgagcttgagcctaggggtacggtcaagaaagcctgggatgccctaggaaacgaagctacgtcccttctagagccacttgctaaggcctctcctatcgcccgtgagttctctgagactttcagggcagacatgagtggtaagcgagcctctggtaagaccatctttgaggatcaggaactccaggcaggtaaatggaactctgaactcgataacatcttcgagggtaagtcttcgaaagagatcgacaggattatctcagatacatccgcaggtgtcaataccccggaagctacccgcctccgtgctttgatggatgacgtaaggaacgaggctgttaaccgaggtggaatgtccgttggtactatccccaactatatgccattcggtctatcccctgagaaggttcaatccccagagttcctgaacgacattactccgtacttccagagccgacaagctgctgaagatgctgtagccaactggctggcagaagtctcggatgatactcgtggtaacactgcccctgaggttaaccgactggttactcagaaccagcagaccggggcttgggaagtagaccctcgctatcgtatccagggtgacccagataccctacgtggacggttcgcccaaagcgatgcagttcctaagtatggtcagctggaagagagtcgggcctttggttctgtacctcaggagatcctcaacaagtattccctgaacgatactcctaagaagcgtctccaggaaatccgggactacttcgaaggggcttcccaccggattgcctttaccgaaaggtttggtatcaacggggagaaggctaacgctaagattgcatctgctgtagctgaggctcaacgggctggtaagcgggttaccaaggaagaagtggatcggatgtatgacctggtggatgcctataatggtatgcacggtcgtatcaaagaccctaaccttaagaagctagcggctgttacgtcgggtgccctcgtgctctcaagacttccactcgccggtttctcgaccctgaccgagttcagcctacccttcgctaaggcgggggttatgcctacccttggggctgtactcccaactatgggtgaagtagtaagacaagcagcccgcaggatctacagtggggttccaaagtctgagaccggtcggtttatgagtgatatgaaccacaccctggcttctgctacttctctgatggctgatcgggttggtgctgaggtgtttaactctaccatccaaaaggcgatccgtggtcagttcctcatcaacggcttgtccatcctaacccatgttaaccgaatatttgcaacagagactgctaagcgggtctatcagaacaacctgatggatctagccgcaggtctccctttcagttctgccaatggtgctctgaaggttgctcagcttcgggaaatgggggttaatatcggtagccagcaggatgccatcaagttgatctccccagccactccatctgaagtcctgatggctaacaacgtcaagactttggctatgcgtcggtttgtggatcaggtagtcctcgaccccaccttcgctgataagcctatgtggatgagcaacggaaacgttcagatgttctccctcttgaagggttacccagcagcctatggtaacatcatcctaccgatgttccgtagacgactgagcccacacttcgctggttcttggaccaacgctggtatgggtgcagcaggtatagccttcactcttggtctgatgatgagcctggggtatctccaggatgagcttcgtcaactggctaagttcggtggatctagccgagaggatacccgtagtccagaacaacggatgatggacgtagtgatgcaacagatgccactccaggcttctatgatctacgacatgctgacgggttaccgtcgagggactacccccgcagaggtagtcttgggtccagtagctggtgctgcaactgagggtgctatggctgttggtaaaactatcgcttcgtttggggatgacccatccgcaggtgaaatctggaagttcttgtataagcaaactccagcacgtcctttcgttgccggtatggaagcgatggaagatgctctggatctttaaggagaagtaatatggcaacttatgtagaaactgatgccgctggtcctggtggccgtgcctacgtggttgatgtgccaaaagtcttccgacgtaatgccgatggtgatctcattgagattacctcggatgccggtcgggtgaatactaacatcgttaccgctacagagttcctccctgactattatgcagctaaggagaacgcagccctggtagtagagaacgttacagcctccttcccggagaacccctcagaggccgttatcccctctgttctggtcaacaccctcgtgggtgctcctggggaaacctcgggtggtaaccgtgaccctggccacgtgattggtctattctctgagaccatgattgaggcaccttgcggtactgcattcggtagtgaattccgggtagaccctcgccgggaacacctgggtgtttacgtggctattaagcacgtgattggcccggatgaccaaaatggtggtaccatcggggattacattatcgagcagtttgatgacatgcgtggtcctgtgaagaatattggttctctccaacagaactacctggatccccgccttgtgactactcacctgggtggtaatgtggtcaacactgcacaactgaacggtaacatcacacttacccgacagaactctggtcagcacttcatgagtgtgtcagctacggatatcaccgtgactttgggccccgatgtaaccccaggttgtgtattccactttgtgcaaggggctgctggtaagatcaattgctgtatctccggacaaggcttggtatgctaagggtaatcagacggagactgatggtcaatttggggaatgcactgtccgagtgtatcctttcggtggtaccgtgggtaccttcaaatcggcagtttaattaggagttagattatggcaggttatatcgctgacaacgacggcaacagtgtattcgttattcaatcgaaggctattgctgtacgtaatgaagatgggaccctccgacaagtcattggcccgaaagactttgagcctgtgaagtgggaggatattgaggggaagccgaagcttctggaggtgggtgctaaggctagcgaggctaagccaggtaactggaagcctaaggctagtgaagtgagtggccttgatgcagccattgcagcttacgtcaagggtaaggtcgctgagatccccgtggcttcctatacggatactcacgaggcactcgttgataagttcaacacactgctgaacgctctacggagctaaagataaggccccttgggatgatacccttggggcctttttttnnggttactcgatggatacctacagtgaacctgcccaagataatacatcgatgaggagtctggatatttctcccagggtcaggagtaacatcagtcagctatatcctacataaaccagcagggcaaacaaggctgctaccgcaatgtaggtccaagggaatccacccttacccttttgatctttctgcataacccctccaatctccgtagaatacagaagccctaaggtctactaggtctagcatcccttcgaggaattcaatctgtcttttagcttcttcagccagttcttcaaaggaaaaggccttcgcctcagccttcgcaagagcgctttgcgcctcttcaagtgctttctccagttcagcctttgtcatagtacaccaccttgtcactgcccctgagaacatactcagaatcaatagtccaactcatggtaggacatttgatccgaatcatcttcggagtaaaaccatcaactgtaccaatagctagatgggatgaggtgttcctgtggaccaggaagactacactgtcccctacctctagcttacgtcccactcggtctttcatagattaccccaagatatccggaaggtgaacgcttgggatgtagaggatctccaggacttcgatggaatacatccctcgcctaagcccctcctcagcaccccctttcccaaacttcatatccagccagagttctgcggagatcggcgtcttaaacgccaacccccgttgaccgaagtcatgctcagacttaatgtagtacaggtctggcaagaacttactcacaggaattcctccacactcatcagcttgaggtcatactctccgtccttgtggttccggagaagggctacacctcgccagtggtcgttaccctggggccctttgtaggactcatcatgggtgtagaagctaccgactacaagcccgtggattcgcttcttgcctactgcctcgatgtggtacttgaatccctgctcatggccttggacgaagctgcgcttgatcttattgaggcgatgctcggcactcccgccgtatggccgaccactgttgggattgtagaagtagtgggcgaaggcgacaccttcgataacacccacgtcgaggaaatcatggacaatccaatcggacagatcaaaatgatcgtacccaataaaaccttggagagcagggttagaattttcataccgcttgatacgctcctcgtggtttccgatgaagaagtgcatttctggtcgatagatacgcttcttacaacccgcttggtgttgctgtaggcgacgaagaggatcgagcagaactcgcatcgcatcattaccagcttgtatgtcagcgaggactcggcggccttcgatcttagcggtaccacggtcgtagcttgacagactgggcatgtcccaatggtccccaatatgaacaattcgcttggggcggttacgtgcgatccactccccaaggttcccgaggtgatcgatgttgacctcggatcgaacttgggtgtccgcaatgacgagagtgtcttcattatacttcttactcattagggaaggactccttgaaagtctctagagtaaaccagcggaagccgttacgctcggcccattccgccatggattgctttgtgccatctttacgcttggaaagccaatggcaagctgtgttagggcgctcgaagataaacacaagttcagtatctggggggagagcttccctcacccagatgtacttagatgcctctgaagcttcctggaagtaccccttgacctcgaccaacaggttcttcgtcgatccacagggttgtaatgtcgataccttgaagtccggcttgtacttgtgcttgatgacgtatggcaccggctccggcttgaactgcatccaaggcatcgtctcgtggacgatcttctcggtttcgctgtcgtacttcgtcccaatcaatgacttcagtttgggtctgaagaatctcccctgctttgccaatgagccctccttcttgaagcttacggacaaccgacagtgtactctcagtgaggatagagttagaccgaatcagaagccagatccaatcccccaggcacacccggaactccggatacttcagtttgatacgttggatatgggagacaaccttttcaacttggttgtcagttaggggctgagagtgatccagaagagggtctaggactcggttaagagtaatacacttctcttccttatcaaactcataagactttgtgcggtagatttgagacctcaagcccagccgatttacaggccagcatgcgatctcacacagtcctacatcaaactctgctggatgtgaatgagtggtcacgactaggttgacgggcaggtcaacaccaatagattcccacacatcaaaccccgcaggatacccatcaggcttatctccagtcctacaccggaccttcttgtggcccagcttgttgtagaaccgagtgacctctacttctagggtatcatcatcacaggggatcaaccgtgggccgaaccggctacggcgagtatcagtagggtcctccacgtatggcctacggacatagaggtcgatatccttgggtgcaaccccgttgtctgcatcccgaaggaaaccaccagcgaccttgtagtcagtgaagccaagaccttcgaggatctcaaagagaccttcacagatcctctgtgcttcatcaatagaatatttcttcatcgtcatagggaatctcccaatgtttcttcagtgagcagtgatactcgttaccggactgctgaatatcaagccaagagcggtcgcgaatgaggtagaggagacgaaagttttccacaaggtactccttccaattatctccgtacttctgttggtaggcgtaagcgcaagctgcgaagagatccctctcagtagaaagctccccaagcaaatctgccgctgtctttggtcccgtccctgggaggcctggtatgttatccacggagtcaccaacaaggagttgcccgtagaggaatgccgtaccgttgccctcaagtttccatgacttctgcggtttcttaacaccatacattcgccaagaagcggagactgttccaaggccatcgacttgaaacggtcccaactccggctgggaatctccacagggccaactgtaatggtagcatcctgggacttggcggatatccttgtctctagaacacgctgtaaagttagctccctcttcagtgcctcgaatcccgagccagtcatcagcctcgataccgtggaaagtgattgctccccacttgtccttaagtctggctgacacggtttcccagtgatgaggcttttcaagaccgattcgagtacccttatattgcttgattttcgcaagctccagcctaaaatttccttggccagtaaggtagatttcacactcatctgcatttacccttttgataatttgttcgactttatcatcgacgagcttatggacttcttcctcgggccagggcttttccacctggatatcgaagatgtgttccttcgacatagccacgtggcctagctcatacctgagcacgtccccatcgataccagcgatcatcacactacctcttctacgacctgagactctttgagcttctcttcccagaagacacggagggcaaaggcttcacccttggctcgatactctgggtgctctaccactgggttaaccagtgcctcatagcccttccagtcgtaatattcactttcttgacgcttggccttgtccatagcttcctccgttaggctgtagcctgggggaagccccaggtctacatcgatgcccattacagagtagttactaggaacagtcttagcccttggatccaacagaagttccattggagtcctcctcttgctgaatgacgagttccagggacgctagggcgttccatacttcgtgataccggtggggtagattactttgggggtccaaagcttcacccttgtgtcgctcaaggaggtgtctaccgaaggcagcatcatatcgctggactccgttctcgacagacctccaacccccgcgactatactttctggctccgaagttagcaacttgtgccactgcatatagagccctcgggaacgcttcgaagatgattccaacatccaccttgccactatcaagtttagcgcccggctcacccggcttgattccattaggatcgacctctactttattattagatgcagatgtagaactcaccacccgtacaccccacactctctcgaattcaattaagcagtaggggcagcctgaccggcatacccccgactcatgatccgctaggcccttagataggagcgtcttcgtcatcgaacacctcgtcgaatacatcctcgggctcttcctcggtgaaggcaccaccgaacagcggatcgtcctcaccgtcaccaccggatacgatctcgtggagtcgtacaccgcgcagtcgcagggccgtcatagtacccttgcctcgtgggcccttttgggtctcgatcaggatgccaacttcaccagtagagccaccccacgggttgggtccatcatacggcttgttgtccgaggtcagaaccaccggcttcattacagcagacttgcgctcaccgtcttgcatccaatccacgtgcttcttctgcttgaccttgaacaggtactcgccatcacgctcttggtatttgatggtacccttcagacgggcatctttggattccatctgttggaccagcttgtctgcctcttccttggtcggaatgcagatggttacttggtagacttcaccgtactcggtgtccggagttacgatgtaggggaagatcagcttcgctaccgggaaggtgaatcgttgggaaactttcttagacatatcttaaacctctcgtagggaagaaggtattataccacaaagggggctgaaagtcaaccccccagatgtatcaatgagtttcataccacgagcgaccagcgatagaatcactagccaaaggacagttaaccccgaggagttccccagcatcccgaacgcagacttccatctgctcacgtagcgccttgagatcctctgggtggcattcccactggccttcgtcgtggatatccaagactttccaagccctcaggtttaacctgcggactcgctcatccaggagtaccattgcccatttcatgacaatagcacctgctgcttgcaggagggtgttcaatgccttatggatcatcacgtcgccagactcagaacgtcgcatggttagctttcgtccgtctagcccttcgagataacccctctcggcttcctgcttaaccctctcaatcagtgcagcaagatcagggttagcctcaaggaactgggcccggagtctagccccgtctgccctggtgcctccaatgatagtcccaatcttggcatccccagcaccgtagatgaaggcgtagatgaacgtcttagcatcgtcccgtgtgggaagccctgcggctatctggttggccgtgtgtacatcaccctcgaccacctctttggtgtactctgggttgttgatgtaggatgcaagcatccgaagctctagaccagcaccatcgtagcccacgaataccaattgattcgctgggacgtatatcttgtgctttcctacaggcttccatttacctttcttgagttcctccacgatgttagtgaagggcctaaccctttcgttctccccaagatcacggcggaggacagtccatttccattcaccagcctcaggtgtcccctggaacaacccacggatttcaggtccgaaaggagaacgagcagcggggatattgactactacacggtgcctcatgcggcccgtaggtgttgcacaagggttagcactcccctctaggcgtccatcaggcctcacctgatctaccagcccctgcaagagggaccgacggtgtgcccaaaccattcgctgcatcaccagcttgcccaggtccccctggacggtatccatcgactcttcagtcatcttcggagtcgttaggaccttacgttgcttttcgagctttctcttgacttccccaatggtagttttcccagggatgatcccctggagcttcattcggagtcgtccagatttgctctgtcggagatcctcaatgtacttattcaaggattcattaaggtcagatccacgtagcttcttgccatcagtgccgacagtaatatccttgatattccattggtcaggtatccatccctgatccagcatccagtccttgaacttggcagtcttaccaaggtcgaagggtacatactcgattgcagagaagggaccagatacctcgaagtgcccaagacgttgccacagggactggagcctttggttcggcttaccactctttaggaatggcttgctgaaggccccagcccttacgatcatcatgggcatctgggggacagcctcaaggtcaatcttgaggattcgttcgctaagcacatggatcagccacttggcccgctgagtctggaagtagactccacgtttactctggcggctgatgatatcagctaccttgtgctcaacgaacagtgactttctccaatccacttaatcccccttaagacgctccgccagattctctacaactgtctccacagcttcgtgggatacaccctccaggtaggagaggtagtccacggtaccactgcggtccagcttccattgctgctccaggaaggccacagcaacttgcttgagcaggaagtcatctacccgctccatgaggatactcttgatcttgctcatgtaatcaccagtcgaaaatgaagtaggaacacccacgttcacaggccaggtctaccaggtaccaggacaggtcgatcttgcgctggatatccttaacgtcgctcagttcttcatcggatagctcgaacccatcaccccgcttctccttcaggtattgaaactcccatttcttctcttcttgggaggtaaacaagaggtctcgcggatctagctgggtattcctgtcgatgtagaagtcatcgtacaggctaagatccttctcccgtacccggctattgcgtttaggcgagtaggaactcagattcaggtgggagcctgagaagtagctcacccccaggaatccagcggggaggctcaggaatacccgacgcttttcccggagagtaatctggggactgctgaggaacttccggatgttagtcctttgtacctccatgctcttatgcagggcagaggccatattacacaggtacttaccacggacatgtttggaatagcttacatggtcactcatttgtatctcctataggggtaaagcaaccccggacaccttaaggttattataccacacttttctggatttgtcaagccttcttgtggaatactttatcgtaccacttgtagaagtattgagcagaagtaataccaagggcacctccccacccggacacgaagataaaccatccgatatccaagtgggaagaggccacggccttgatgtaagcaaactgagccagcgtgatacaccaagatactacaaacccagccttgatcttatcatcccgaaggagcttagagttcagacccaggaggaacacctggaagaatgcactccaaaagatgactaggacttgtagggttattgacatgactcacacacctcgggatctaggccacaggcactacccaaggggaagtcatcagcatcgatctcggggccaccccagctaccagagaactccttctccagggcaatctccttccgtgcctgatcctccaggctttccttcttactcgccatcgttaatctcctccacagaaacccatccacggacagccccaacctcgttggcccgtacggtcattggattggcatcggaatcacccaggaagaaccgaatgatatccagttctattcgatagaagtccgcagtgaacaccttggtgtcctggaaccccacgttaacccgatacttcttcattcttacctcccagaagctcttcgagattagccagtaccttctgggccttcaggttgtcctgcatgacctgggtacgctcagctttgagcaggctgatctcgttgtagatgcgctcagattcctccgaagactcttggatgaaggtcttcaggttcaccagaaccttgtcgaaggaactgaggatgttactgatgctaagctttcgattgaacatagtgagtcctcgggggcccgaaggcccctcttcatttactttttcttgcgaatgcctttggccttacgatcgcccacccgaccaccatcagcagcgttagaagaacggccacggacgcgaaggttagaatccccgttaccgccaccatctttaacacgtttgatatgatcgacaacctcgtcggctccgagcttccttccaagacgcttttccacctttcggcgggccctgtgccgctgagcatctccagacttagaccccacgcccgtttcgccgcgtcgaatagccagttccctttcacgcttgtagttcctcactcgctttttagccaatctacagtcctccattcaacaagctcttgccaagtcatgccgagtacccggaggaggtagttgaacagtgcgtgactgaccactccatcctgaaggcaatactcaaacatttcttcggagaacttggagaagtcgttaaagtcacccttgtgacacttcaggaacttaccccaggctcccagggaatgaccctggggcctatctggccaagtcaacctcgatgcaaccaaggtgtcatagcttcgatctgggggtatgataatcccatgaagtttctcaaggacccggttgtcgtagtcaaggatgttgtgaccgactacgaactttgcatgggcgatgatgcggtagaacacatccatttcctcgggccggaatccccggactaccccagtcggaatgtctacaacaacagcgcaccaaagccttgtgaccgtattgaagaggccgtccccctctaggtcatagataacgtaatcaaattggggtgtcatcgtcagcaggtacctcgtcgtaactgccctcacgttcaaccaagcgacccgtctctgggttatacttggtaaacactaggccagtgttaccgtagttcctgtccttgattacacggattcgactctcgtgcttctcttcaccgtcagcctgcttgttccgctcgaagccgatcataagctgacaccaacgctgcatagctcgggagccggtgaactggctttcctttacttcagcgccttcctcgtgggtacgattacccttgggcgggttaaggtgggagaagatgaagatccgaagacccagctcatcggccatacctgcaagctctgtacagatacgggcgatctccgtgttcatttcggaaggactaaggtggttggtcatggcggtcatgttatccagcaggatagtcttcacatccatggctactgcccagaagcgaatacattccttgatatgatcccaatcgttctgacccttgttcttccacatgaagagcttgccacggagtttacccgcagcgtctttaaaggcttgctcatcccactcgatatccggtcggtggaagggtacgttagctaccttccccgcgatattcttcagtgtcatggctacctgctcttccaacaggaatgtccctacgttctccccgtgctcaatgcaattccaggcagcaatctcgtgggccaacagggtcttaccgatgccagtacctccacctaccccgatgatctcaccatcacgctggccataggtaaggttggttagaccttcccagggatagctcttaccccacttagggggttctagcgcctcagcgtatacctcatcgacagttacggaacagtcaggagacttcaccttactaccgaatcggatcatctggtagacctcatccccccgattacgcatgagcatgtcgttagcatccttcagcgggagctcgacaaacttacactcagggtacagggcacgtaccttctctactgacttacgaccctcgtcatcagcatcatggcaatagatgacctcgttgaaccgttcgagtacaccagattcctttaggaatgcgatatctcgtccagcggaaccaacaccagaggaccagctaatggctgcctgacgcagatgcttccacttctcgggaagtttcgactccatgatctgggccacagacatagccgacagttcatcctcgcagatgactaaccgcaggtgtcccatatccttatgccgaagggtattatacccgaaggggtctacaccgcccttggggctaccacgatagtagaaagccttggggtctaggattcggacgttaaacgctcggtactccccatcgcgggtgcgtggatagtaatgctcgataacgtcctcaccattttcttgtgatagaccaacacgtaccccgtatcgttcagcgattgatttgcttatctttctagtatcgagggctttaattggatactcaaggacttcgttgacttcatggatgatatcctcttcggacttctcacttcgttcaggaaccttgaacccttcttcgagaacttcatagtggccgcaacggttacaactaccgaagcgggtacctttctctttgtctacgaacaagatgaggtgattacctgttttatccccacctttagctcggcaactcggacaggccgtatcaccgataatctgcttcacttattcctccatctggctcttgagcaccaagctaggtacagcattgacgttgcccggtagggtcttgtaaggagttgttacgaaagtaccgtagaccttctccagttcacggaggcggtcctcgatcttcttcagtcgctcccacatgaagcgaataccaacagattcgtcacagtacccaccatagctggtctctggactatccgaggcctccgggatcttggagacctcgatggaatcttggaggtgtcgttgggaggcgacaaggcccaggatctccttgaggagcatcttctgggcatgtagctcttggtgtccgaaggtgttcggggtatcgcggtagacttctactgctttgtctacggtcatttcattcattatactgccccttgtcgttttgccaggtgtgccttccagtcgccatcttggacgatatccatcgccatatggctatcctgatggtacaccagggccttgattcgttccccattgattcggaaatccttgagggtacgatcataccaacccggataaccctccagggcatccaggttctccagcatttcctcccccttctcgccttcggggagttgccagatttcacctacgatgagatcagcgcgggaggcaaaggagagtatggggaagccgccagcggagtacatcaggccccgctcgcaggatacagcattgccgacaaactcggccccttccagaaggtagtggttgtacaaaccagacaggagagtaccataaacgaaaacacgaacagccattagatagtctcctcgaagattttgttgaagcccttgacgtaggcctccagggcgctgccttctgcatccaggcccggcgcggtgttgatttccaggacaaacgcccggctagtggcatgctggaagatgatatctactgcaccgaagtccagtccagccacctggattgcctctgccgctgccgacatagcctgctcagcaccatcacggtccattgcatcgttaaccccgtatacccagccgccagctacgttacgaacgatgctttgtccttcgttggtcaccatttcattggcaacacggcggagcttgacttggagaagtactacttccccacggatcacatgggctcgaaactcggtacgcttaccgacgattccctgggtgaacagttgtgccctggtgataacatccgggatgtgggtgtgaccgtagatgtgtaccgggtagtggccctgtctacggagggcatcgattgcagcaacttctgcatcgttgacagtacacaccagatggataccacgaccgctatggccgttcagatcggtacgtgcatacatgcgaccagagatattgagtacacccaaggcatcttcccagcgctcggtccaacggggaatcaagtgaggggcattggcctcgaagtggcggaagaactccagcttgttagcgcagcgataaacaactgccgggtcgttgaggaacacaggggcaatatcccggagtcggtgagcctctgcaccaacggtaccccagttgattaccgcagtacccgcacgaccccgataggtcgacccctcggagcgaaggattcgagcacccagggcgttacgaagggctacagcaccagcagaggggcgggaacctttatagatatagaacatggcaaatctcctgtttctgttgagggtagtagtgaagccagcaataacccctgaattcctaagtcagatcccatgtacacatcttaggaaccggcatgggtcggccaggggttattactaacgcactaccttactcgaagtagtcttcgaagagtcggtcgatagcttccgcaatgactaccggggccggtaccaggaattcctcgtccgggttggcatcattgagttcctgctccttgactcgacggatcgactggatcttatccagagtgtcacgggagaagggatactttcgggttgcgtcggtctccatctggatcactacttgacgcttcatcgttacttgggtcattttgacctcctatttattttcgattacacactcaccacagatgaactcgcactcatccaggctaccagtgaacttggcaccttcgtataccgtcagatgacgattacgctggtcatatgcggttgggatcttcccgcaagatgcacatccctgggacacgaagtcccgaaagacatgcacgttgttgaaggtgtggccttgcaccttcagggggtaggtgatgttggccggaggggtgttccccgaggtgccgccgacttgaaccctaggtttagaatgggatttcgtctccgatgagatcgttccaatcctcaacactggggtagtctccccaggagtcggccgatgctttgggtccaggcagcttaccgccagatcctcgacagtaactttgagatcacggtcttggccgatgaagtatgcgttggagatactccctcggaggacggtgtatccgtggaccttggcgacgttgatgccatgagcttcgatgagaaggttctcttcacgctcgattccagtgacagttccgtattcgctgccgtttgcgtaggcctcgatcttgacaacatcgaaggtgacaagctgccggtgcttgaaggtgctacctgctgcgtcgaggttgttgttgatccggagggtgttccttgcgtacgcatcgccagacgttccatacgacgagcccgcttggctgcctttcgttcccgcttggctgccttggcttcggctatagtcctcgtagtccgagacaccgacgtagctactccaccatgccgctgtttgcctttcgctttcgggaattgggaggtccagaaacgtgaccggagtggtctggggttctgcaccctttctcactccggcctccgtgaacgggatagttaccaggacttcagccttcagttcagcgatgggagaacgaaggcggatcttagcgttgggtcgctccaggaaaaccttgagcatcccaggctcagacgcccatacgatagtcccggtggtggtaaccgccatgaacagaggacgatcctcgttacggatgaagttcaggctacgttccttggagtcccaccagacaaccgcagcagcaccagagaacttctcctcgaacgtcttcttggcaccgtggttggcaatggtagcgcacagcatgttcgaatccacgttgtacctatcattgccatccagcaggtgcaggccccaggtatctacggtgccgttatgtaccatggtgatgtggtctacctggaaggggtgggcattcccatggtccgtcttgtcgcccatcgtggcgtaacggttgtgacccatatagatgcgagcccgacccttgtccaggaactccttggtttcaggatcagccaggaagtcgtaggcatctactgcccgcttgtgaattcctacctcgttcttaaccgggtcgatcttggccaaaccggtggcgtgagcaccacggataatatccacggccaggagggatttgagaagagcgatttcgttatcactcgcgttagttgtggcacagaagcctaccaatccacacattgtatttctccttagtacatatctggttcgattgttacgccggtatggcgctgaaggtgctgcgggttgtccatgagcgctacgaaggcatcttgaagaacctcttggtcctccagaaggtctcgtacacgaacttggtgaccaatacgacgcagagaggttaccgcagtgatcgctgtatccagtcgaacctgggtacctggcaccattgccaagttgtaccgctctgctgcaccatctagtagtcgtgaggtagtagcgcgagccaagagcagcctacgatccaaggcccgctggcgctcacgttcctgctcccggagacgacgctgacggttctgttcatcttccagaggatctaccccggagcgaacaaagcccatggttgctaccgcgagagtagcactggcgatccccatttcacgaccacccggagacatttcatagtccggagatacccccaggaagaatacatcacggaggttcacctcggagagcaccttgaggaactcttccagcggggtttctgcgtgagccatggcgaaggccttgagacacaacatacgctgcatcaggcctaccatttcctgccgagtagtgagagcatgggccccacggaactcgatggacccgaagttgtgggttacctggaggttcaaggccgaatactttggccaggaggtaagacccaagactttctctcggtcaccttccggggccaggatacggcgaccgaaggtctgggccagccagtcgttgctgaagaacgggatgcagaagttactatcccgacgatacggttggcagtgatcgaagaaaacatcctcgaatgccatgtaggtcaggaccgttcgttcataaacaggccactctacgtcacgcatatccatgtgcaggtgggtggagcaacggaaggtgggggccggaggagtttcctccatcgcactcacaaaggattcaacccgagtgattgccttctggccagaggcgggaccagagaagacatactccataccatcccgcagagagccgtcacccttcagatcccacccgtccacttccggccagttgttgaggccttccagttcgacttcgaacccgaaggaagcaaccgcaggcagttcctcgtgatgttccggggcaatgatctggttcttacggaaccctatctgtgtgccaataactgacatagcaagtcctcctggttcttgaattgttcatctgcggacagtcggccatctaccatctgaccaaccttcacccccttccagtgaactaccccatccttgatgaagaagtcccggtgggatggggcagagatcatttcctcggcctgggtgaagattcggatcatcatttcgccagtgatggcctgttgggcatggttcagcaggatgttcctggggtccatacccttacgctgagtccgattgttcacgaggaaggatacataagtatcacgaaccccacggccaaagacgtcatagtacccactggaggatacataagtatcacgaaccccacggccaaagacgtcatagtacccactggagggccgcacgctttctacctcgctgtagacaaccccaccgtagtagttactgccgtcggggcgatacacattacccaggagacgaaacccgtcgaattgacggtcgtcaccaatggactcggtatcgtccacgtacactacccgaggctcgccgtcaacccggaagaaggcataggtggaggagtagtacatgttgaagtccccggccaaccgatggcgattattcaggtcattcatacttcacccccaaggcctgaagtgcagctaccgccgcagcgccgtcgttatcgttgatgattcgctggacttcatcgccagatacgatggacttgtactcctccaggaggtgcttggaggtgtaagcctgtactgccatttcatagacccactcggtcaggtctacagagaagatccagaagttcgacaggctacggtactctccgccgtagggcttatagcgcattgcaccagcctttccgtacagcttcttccgctgagtgtcaccgtcgaggatgacagacgccaggcccaggaggtagtcacacatctgcatgacttctcgggtggtagccttggtgactcgctcgatgtggctgaagccgatatggacgtggccgccagcagtgcgcagggtcggaggggcatccttcggcatcacgttctgacgacgagtccagcagttgtagtccggctcgcaaccgaagacgtaagcctggggaccgaagctgcggaggagttcctcgtcgtacaggtgagaggacaggttctcgatgatgttcatgccgaaggggtggagcatctgggcacccaggagtcgaacggagacgatacgctccacgaactcttccttggtactggccgggtcgatgttgtactccagaagaacgttgtcttcctggacagcaccaccggctacagccaagggctcttccttggtgccgccgatgaagccgatgacgctctgggggttacggtcgtagccgacgaaaacttcgggatctgcaccgatcagggggattgcgttgttcattgcatgttctccagtttttcgaggatttcggggatgctatattggctggtgggtacgacctcggacctttcccgacctggatcacctacgtcaatggtgattggggccatgatggaaaggattcggtcattaggtacaccttcgagaccgtcgcattcgatcaggcaatcatccttggtatacccctgccacaactcagcgtcgtgatgcttgagcttgtccttgaactcttcgcgagtccgctcatggatgctcttaatatcgaagtaggtgatattcttgtatccacctacgataccatccatgacctcgcttatgtagctgtcatccacctcccagccgtggctctcgcagccctccaggtattcaccagcagtcaccgggaacatggccgggtagctgtcgcaatgagcagtgctacctacctgggcacaagccgcgagggtgaggatctctgcattgcagcccaggattttatcacgattttcctgggtatagcgactcatggaatcacctacacaccacaagctatcgcccattcggagggcacagatgatggccgatgcgttcttcctgaggtctacccgtacatacactgcctgccggcggcctgggggattgaagtggtcgggatcactgaggttcttgaggtcatcgttgtaatcccaccaacgggtaggccagtcgatggaagccgagagaataccaccatcggtgatcctgttgaccaaatcactgttcaggaactccaccagtttaccagaggtattctcgtgggtagataccaacaggtggccaaccccggtaacccaccggtcacccctaactctggaggtcttgtcgcaataggctccgaagcagtttgtatattcggccatgctcttgaccgagtagtggtgtaccacagagccctcggcatcgtagtacacgttatgggctgcatacattcccatttgatttctccttggttgtcagaagtttttctcgatgaatccttccagggccagggggatatcccttgagccgcgaccccagtgaatttcacccatggtccccaattggaccaccccgtgcttttcacagtcagaaggattaagccggaggaatcctcccagttccgtatccacggtgtcgtagggggttttcttgccgaagatagttggctgggggtaaatagttaccacctccaccttgttcagcttaatccccaggtattctgacctgtagggcttggaccttacccactcacgtccacctggggcatcacggttgggcacccaacgaccgaatcggttgcactcttcggcggactggatgtggatatcgcccttcttgatatcctcccaatcactactgaacatgtagttggtgaggggatacccggtgtagccgttggctatcaacccgtggaaggacattgcgaggtaggacttccagaagccatacttttcagcaagctccatgtgaatcttctcctctcgaccttgagggtctagaccactggataccagcttgaagaggaacttcatgatgggataccaggaatctagggtatgttccttggggttgaagtagataccgcagaccccttcttttccgtgatgggtgggggaaatcatttccgtcccgttagaatacttctcgaagggggaatccttggccttgctttcgtaagaccagaagtggaccttcgggattttgaaggccttgccgccgatggtgatggtcttgagttcaccttgggtacacttgttgagtacatcgatgaacttcttgcttcggcgggagcagatgaaggtccaaccgtcgagcttatagccgtgggttaccggaccttccattgtaccgaagcaggaggaagaggtcattaacttgagggctttaccctcgcccttcttgggtttcataccgaaggcatacttgatacgggccatttgttttctccttggttgagttaaccagcaatacccccagggagttcctaggggcattactaacgccctcttagaaggggccgcgacgctgctgcttgcctttggtgggtgccgacaccttggtggccttgaggttgccgttcagggtcaactcaccgttggagcagagacgctcgtagaaaaccttacgcttacccattgtccacccccttagcgaacgttgatgaagggcatggcttggccgccggtgacgtaggtgggcagcttgccgtcccacttctcgatggcattcagttctaccacgccggggttctggcggagggcttcaccctggatgcggaggctttcggccttaccttgtgccaccaggatagccgcttgcttctcaccctcggctgccgcgatagccttagctgcctcggcctgggtctgacgcagttcgttctcgcgctgcatcgccgtctgagtggccttgatcttggcattgatcgcctcgaccacctgcgccggcaggcctatcataccgttgaggtacaggctttcgacgatgatgccacgggtggagaagtgctcacggacggcagcttcgacttccttcacgaaggcttccttgcccggaccatagatggcctcggcggacttcttgctgctggcgttgttcacggcgttacggaccacctgcggcacgttcacgcttacgatctcgttcatgcccttgcggtaggtctggaacagcaggggtgcgctacccggagcagcccggagggtgacgccgatggggaagtcaagcttcaggccgtccttgtcctgggcagtaaccaccgccagatcgaagttctggttgaaggtggggaacttgaacagttcttcgttgggggtcaggaacttccagccgaccggggtttccttcagatcaacgcccttggagtcgcccatcatgttgacgacgacaccggtatagccagcgggaaccttggagcaacctgcggtgatggcgagggtagcaatggccaggaggccgaggattttcttcatagggattccttacttgtagagcagaggggtgatgtagaccatgcacaaggcaatgaacatgataaacatcagtacgtagaagccccaatcatgcgggggcttacctgggtggcccagcaggccgtctatcttatgtatgttgtcgtagaggtcggaggtatctcccccgatgccctctaagtccttttggattgcctcacggaggcggcctcgcttctgttccgtcatagtacatcagacctccaccgtcaggacttcaccggtcgccagtacattgaagaacagggacagttcacttggcaaacacaccatgatcgaaccatcactgatattaatcatggagatgaacccacgagcaagggatctttctggccggatataaacctgggagtccttcttacgttcgaagtacagggggagggatggcttaatgcccctcgttaccttggccatactacacccccttcttgccagtgagcttcttggcgtaggaagccatgtggctcgcaacccagagggagtagaggatggagattaccaggagggcagcaccgatggcgttaaccatggtgttagcgagggaaagcatctggggtactacccagaggatgcttacccatgcggggatagccagaagcattacccgagtgtagagcttgaggaccattgttcttacctctttcttaagatgaagaagatagaaggttagaaccttaggtatcctaaaggatataaagcaaccccggacaccttaaggttattataccacactttcagcagaatgtcaaggcctagatgttacagacctttacagagcttgtcgaggtattccgagtgctcgacagtaccggggaagtcctgcaaaccaccgagtcggcggatgaggacaccatggttgatgaggatttctgccgcagcttgcacgttgatgacgtgaacccgaaccttcgtcgagtggttggcgctggaggcccaggggttgtagtggctgcccatgcggcggaggatggtatcggctaccacctgctcgctgttcacggtgaagaccatcgttccatgaccctcgttgtactcacgacggacagcgccgatcagttccttggcgaaaccacgggggctgaacccattggatgcgaggccggcgtaatggtcagctgtacccgaggggcccatgccgatgtaaatcttggcggtgcagcaggaggggaagtctttgcgttgcattagtaatctcctttgattagtcgtttggttgatccgatgagaataaccagcgggttgtagataacagccatgaagcacatccagggaagcgatgcaggccacagggcacccatcacgattgcaatgtcccggtctctctggcctatcattccattctggtcggctaaaaagagtgcggaaaccccggatatcaaaagggctacagacatgtaggccaggatcgctgggattatcaggaggtatgtcatcatttgctgcggaccaccttccgatgtacgtcaccacagcgatcacacctcaggtcgtaatagtggcagagttccactaaccgacccttgtgacgaatctcgtagggtccaccatcaagtatcttgtaccgatggacgcccaagagacaccaaaggttgccgagatccatcaccaatccctcgcgcagttgcaacaacgaccctctttggggccgaagactggcatacagtgggggcaaggctcaccagattggatcatagcctccctggcgtgccgcaggtaagccgatcggctggactccacacctacggctgccagggtgaaaccaagctcaccacggggctcctgggggccttcctggaggctcatgttgaacccccgcttttctacccgacgcttcatgcggcgctcctgagccattatctggcctatcatgggtttattcttcatacggcccccacatcctggcggagacatgaacgtacttagccgggaagagttccccatgaccaacgatcctgtcggactcgaagatggagaagccgctgctggtgaggaccgttaccatgccgccttgcttgaggtataccacggttccagtttcccgctggtttacatacacaccatcctctcgcttgctgatgtgcaagtcatttcgaggttgggttgccgttatggtgaaagtagtcatgggtcacctcagtggacccgatgaaccttgtggtccaccggaatgccgagttcgtaaagggtttcggtgatgaactggccgaagttgatgaccttcaggtggaattcaccatcgggactggccaaccaatagacttggggttcagtggatttcatagacgatacctgcacgtttgccgaagatcgacacacggatatgagtaacagaccagttggggtacagcttggggttaggctggtatcgccggatgacaaccttggataccaaccagtggtagatgtattgggcgtgcgtcatagtacacaccctaggccggtgggccgaaccgatggacttcgatggacgcagccttgatggtcacggggtagaacccgcagtcaacatcgccgctgaagtatacggcacccacgggtccaccgaagatatccacgatgaagaattcatctgcaacttccatgtacataaagacacgcgggtttgcagccccgtcctcgtcctggcggatgtacagacgccccgactccagatcatcccaagaggcaacccggatcttactggtgagcatattgtagttgagtttcatgttacacctcgtagcaattcagctcggcagttactgggtataccaggctcaccggaggcatgtagatgacgttgccagtcttgagattgagaacggcaacctcatcagattcacccttcatcctggtgctgcggagttcgcagaccatgtacacatccccaccgatgaggaaggtttgggacttaaccagagaactgagggttactccgttgcgtggccacaccttgatatccataggactacctcacgatgcaaaatggatgctgtccaaggtcgaggacaggacgaagagaaccacccacgctaccagcaacaacccattggaacgtgagcgtatggcggcacatgcaatatacttccatgacattaccgcgccctgttcttagccagcgatgcacgcttggcacggagcttgttcaactccagagttttaccaaggtgattgccgctggagttggtcaactcacgagttaccttggcaatcttgcggtcgatagcctcgatggcttgcatgttgcggctaaccttacgatagtcgttgcgtttcacgggatagtttcctttgttgatttcccaagacgccccagcctgcgaccataggtccggtgggggtttcggccaggaatcaccatggcctcatcagttgggttagttaatacccatctcttccttccagtcacggaagaagaagtatccgataccaatactggatacaatgatagcgatggtcatttgcttagtttccttatgagttcctggcgctcaacaatccaccggggatcgggatgcacccggatcatcctagtgagtttcttgagacggttaatcatctgagcacgttcatgggccgcttcgtagggtgacttcatttgatccacccgcagacgctcagacggataccatccgtagagtatacaccgcaggcaaatttaccgtccttaaaaacccagcggtaaacaatacccccttgccaacctacccttgcatcgcagaaaccagacacataaccccgatcttggatggaacgagcctgcccaaagatacagtaacccacggaaacctcctgatggtctatcgctacaatgcacggacctaccatgcactctagggatagacctggggcgcgtcatagtacacaccccaggcgcacccgccgtcacgctgccttagcttcgtccttcacttccagacgttggatcacggcgatacgctcgtccgctgcctggagctggcccttgtcgatggcacgctggatcttggccttgaaggcagcgatggccgcgtcgagtgagaactcatcggccacgtcacgctctttcttgtacttgaaccagggtttctcggctgcacgctccagtcgagtggccttgtccttggcgaagacgaacgggaattccttggccttttccttgtcggtattggccgcgatcttgccgttgtctacgaaccagtgggccagggccagccggcgggagccttgcggcatcgcgttgaacagcttgcatgccaaggacacctcgccatgctcgtcgatatgcttgaggatatccatgccggtggtttgaatcagtttgtccagggatgcaccacgcttggcgatggttttgatgatcccattgatacgcttgtagtcgctcataacttatacctcggttttgatgtgggtgacgggggagttcttgcacttgctaggcttgtaccaattgcgcagcttagtatcctctcggttacgccaatcggtattcatcagagcctttcgcttgcgtgctccagctttctcctgtagggaaacatacttactgtccaggattttgttacaattggaaataatcccgaacttctgttctgcccgctgctgagccttgccaagatgcccaatgttgataccttgggcacgagccttgcggctagccttgcggcgcagcttcttatcgatagcagcgttcatcgtttcatccttttggaatcatcagccgggacacacatcccgatacgataaaggggttagtcggcaaaccttggcattggcgtagccggaccctttccgcgttagtatcgctgttatggcctgtcctctggctatcctcgggagtcttcgtgtctactcgtccctaccttcgccagtatctaccaagcttcgccctctgcgctaagccattgatactaacccaacatactgtccatcacgattccaccatggactctgctaattgtttacgctggagcaggcaaccagtcggaaagtcataaggcagcgactttcaaagccagcgctctataggagtatgcgctattccctcagctttcgggtttctcccctgttcagtccaaggaccgtcgagggtacactttccccaggtggccgtcacctgatgggtgcccatgttagaggcttgggtttgccttgtcaaccctctgacgggggttagttcgtccggttctccggcataggctcttttgctgggtggccatcagtcttgcttgtcaaggctacgctaatcccgagggagtcatgcacgttatgccgttgacgtggggcgaactataccgcttcccctaccccttgtcaacccccgatgcctgccggccttatacttgggtgacttgggcgctcttccttggttggcagcccccggatagcactgcggcaagggggatggtggcctaggtagaacgtgggggccattaggcccggttccggggggtttgtcaagcccctggggtttcccccggtgcctatcggtttccctcaaggcggcgccattacgccatattctttacggggttgtctactggtttttcatacagtctatggactatcagtcccccagcaaacccccggatatgaacagtctttgactaacatagggtatcaacggaagtcaataggggatcaaggggttatcaatggatattcccccgatccaccccctgaataccctaagatttttcttatgaatacccttgggtccacccgatgaacggtatccctaggggttgatcttggggttagtctcatggtatcctagggaggggctaggggctatacccctggggataggccacccccactttatctgggggactcctgggggg

SEQ ID NO: 10 - DNA, 66431 bp, artificial sequence
  BP1650
tcgcgtttcgatgaggagattatgccgatagtcagaatggaagtaaagtgtctgaatgaagaaatttctgaacaccgacgaacggttgtgctcgaccgtctgctgcggtgtcgatatactcggcctattgcgaacaatggactgattaaatgtacaaactcaatcctgcgctgcgagcggtctggcgaactcgcgcccgttacaaagtcatctatggaggccgggcgtcttcgaagtcgcacgacgctggcggtatagccgttttcctcgcggccaactacaggctcaagttcctctgtgctcgccagtttcagaaccgcatcagcgaatcggtctacacgttgatcaaggacaaaattgagaattcagagtacaacggcgagttcatcttcaccaagaactctatcaagcacaagaggaccgggtcagagttcctattctatgggatcgcccgtaacctgtcggaaatcaagtccaccgaaggcatcgacattctctggcttgaggaagctcactatttgacccaggagcaatgggaagtcatcgagccgaccatccggaaagagaactcagaaatctggatcatcttcaacccgaacgaagtgaccgacttcgtgtatcagaacttcgtggtcaagcccccgaaagattcctgcgtcaagatgatcaactggaacgaaaatccgttcctcagtgagacgatgcttaaagtcattcacgaagcctatgagcgcgaccgggagcaggccgagcacatttatggcgggattccgaagactggtggcgacaaatccgtcatcaacctcaagttcatcctcgcggccatcgacgcccacaagaaactcggctgggagccagccgggtcgaagcgcatcggcttcgacgttgcggacgacggcgaggatgcgaacgccacgactctcatgcacggcaacgtcatcatggaagtggacgaatgggacggcctggaagatgaactgctcaagtcgtccagtcgcgtatacaatctggcgaagatgaaaggcgcctcggtcacttatgactccatcggcgtcggtgctcacgtcggttcgaagttcgccgagttgaacgatgccagccccgacttcaaacttatctatgatccattcaacgcgggcggcgctgtcgataagcctgatgatgtctacatgaagctgccgcacacgacgatcaagaacaaagaccacttcagcaacatcaaggcgcagaagtgggaagaagtcgcgacccgattcaggaagacttatgaagcggttgaacatggaaaggtttatccattcgacgaattgatttcgatcaactctgaaacgattcacccggacaaactaaatcaattgtgtattgaactttcgtcgccgcgcaaagacctggacatgaacggccgattcaaagtcgagtccaagaaggacatgcgcgagaaacgcaagatcaagtcgccgaacatcgctgactcggtgattatgtcggccattctgccgatccggaagcccaaaggcttcttcgatttctaaacacagaaaagcccggatcgctccgggcttcgggtcttactcggtatggttcctggcgctgagtgtcgatgcaacggcctcgccgactcccagggcttcctggccggccgcgagcgcttcggcttccgactcgacgatgaagtcatcaccttggccgtcgccgggcggaacctcgaccagcacggcttcttcgccctcgaaacgcagatcataggtcttttcgacggacagaccgtaacgggcgttgagcgcatcccagagctgagcttcatagttgcgcaggtcttgcagagatttctggtggctgagcatcgccatatcgacggcccgttgcagggtttcgtccaggacgttgaatcgcatgcgaagagaacgaatccgctcgaccacttccgcatccaccacatgtctttcgatcatcacttttcacctttgctgaatgttacgttgtagccgttgtcggccagataggtcagggcgccttcgaaggaagttccgacaaggtgcttgagctgcattttgcgttgcgcggcgatccagaatgccgttccggagaactctgcgcggccttccgacaaaacctttccatcaggcccggcgatccgtacatggacggaagatagcttcagtgccatcagtggaccgtccctgtgaaggcgcgcgccgccgcgcattgatcgcaagggcactccctctggatgcgcgccagatcgtttgcatccagggcgtagagttttccatctacggtatcgtgagccattgcgatgtccggatattcgttttcgtccaggccggatgccgcgcggatgttgttccagatgccggcatgttccgcgcgatggcgcgcggtcaactcatcttgctctttgttcgccctttctacgaatttctccaggacttcggtgaatttctcatcgatgactcgtgcagacttggcggagctgaggcgaatcgggtctttcttcatggtgattctcttttggctggtggttgttcgttgctcaggcctattcacagcctgggcagcatgatgaatatgaacacaaaggctgcaaacgccaatagcgttccggtaagcattttggactgactctgcatctcagcgtactgctcagtggacattccgtgctgcgccgcctcggccgcgaagcgggctttcgcctcgataacttccgggcgcagcgacaggacatattctaaggcctcttcccgcgctttttcggcctcgaccgacctagggtcgcgggccgagacttcgctgtgccctggcctcgcgggatgggcctgcagcgatggcggaagttcggcggccacgactccatagtcggcgcaggcccaagctatcccgatgaggatcgcgaggatggattgaacgattcgcagcatcactttgtcgctaggaaagctcatgatcaatcctccaccgaccgaacgatttccatgttgcgcccggcattggttccggcagtgtaggcgcgccgaccgtcgctgtcgtccaggcgcatgagcttagtaacattggacttcttgtagccaggatcgccgaaatgttcgtgaaccgcagcttccttcaccaccaccagagacgttccggcagaagataccagctccatacgcttcctggtgatggattggaggcgatagctgatttcctgggtcgcggcgagcttgaattgcgcggcaaccttgacgttgaaccgttcgaatccttgagctttctgatactcccggcacagacgatcaacggcctcgaccagggaattgaacatattcaccgccagctcaacgtccgacttgtagcctttgaagcgcacggcatgaccccagcgcttggtagtgcttccgtcgcgggcgctcctggatgccttagccgatgctctgtggttgttgatgccaccggcgaaatccatgatgcagtcattgtacgtcgccacggccactgagaaaaacttcatccagttcgggattgcggaatagtaacgagtggcaatttgctcatcgaactcttcgcgaatctcgccggtagcttcgaagtcgtgaaggtcatatttgtccttcaacttcttcacacgctcggcagcgatggccgcttcgtgcggactggaagagtcggccgccatggcggtcagcttgcggatgcggtctttcgctttctcgatggcttccggggtgaattcgttctggtcggtcatgttacgttccttttgtctgaagggtttcgctttcgatggagctattctgccttcatccagaatggaagtaaagcattttcttccattatttcggaagagcctggaaataattccaagcccagtcgcctgcggccaggacgaagatgatgaccgcgaagaacgcgattgcagcgaccagttgcgcgcccggcttcagcttgggatggctgagcttgggctctacgggaacgcccggagtgctggcgctggaaccggcgtctcctgggccgtagccgattccacgttcacgcgcctggagcgacaccagggatttcagatactcggtctgcttttgcgactcttcgtagatgccggcgacggcgaaccagagcgcgaacactacggccgtgcatatgacccaggcgccggtcagcaggagggccagcggaccgatgaggaagacggaagcggccaggacgatggcgccgccccagatgatgaagccggccagaccattggtgatgtcgatacagaactttttcattttcagattccttcggttacgggatggaggggatttggaactctgcgccgccgagaacatcaatgacgacttcccagagcgtcggaacagaccactggtaacggtcgaagtcggtttcaggatcgacgcccagcgtcacataggaagtggcaggccatttatgaacactgcctttccgcatgagagtcgccacgcggccgtcaccgagcggattcgtcctgtgcggaacgtacgcagacatcgaatattgctgcccggcgtcgacaacaaatctttgcctctggcgcagacatacagagcccacaggattccagccgcgaccgccgcaagcctggcgagccgaagaatgctcataaccttcgtgagtcatttcgccgaggcaagccgagcgatcctcgtaatagttgatgttctccatcgatccaaccagcaccagagactcgaaatcgaatcgatgatcgtggatggccgagtgattgaagcaaagccgacgcggcagctccgggtgccaaacatggaggcgaccggccggaagttggacctgaatgaaccccaggccgtgcagagtgatcttgtccttcatcgggtcatggacggtgctcatggataatcctcagtagcagaaatgtattgtgagagttacgattgacaagccggtcgcccatagaagggcgaaccaggccatggctttgacggtcgtgtagatcatccgaagaattttccggcacagatcgggccaatgcccatttcgatggatgcgtggttggtcaactcgcgaccgcagcaggagcactgaccagtcttccgaccgtaggcgactgccgattccatcggcttttcgaacatcttcagaacgtcgtcgtgctcagtatcggtgcagtcgcgactcttgatgaatttgccattggtgatccggccgaggtagatgtcgcccaggacgtacaggctaccggcgttccggctgtgagcgccagcctctttcacaacaacgatgagcggctcctcgccttcgccagctaggcggattttcgggcgcttgataccagactctttcgccttctcaaacgctttctcgatgccggaaatgtccagagtcggcgcagcagcttcctgcgcggccactttctcgcgatacttggcgaggttttcgatggcgcgcttcgcagcagcgatctgattttctgtcaaggagccgtatttatacaacgactcctgaaggctctgagcgaagctgaaggaatttccagtccaccactcgatgatgtccgggtgcgcggcttcgaaggccttaattttgaggtcgcgctcttgcgcagcgctacagattttctcgatgcgcttttctgccgccttagcacggctcttggcgcgctgctccgggctggttttgtactctttgtatccgacgccgccgcaggcaaagcaggcgcgaccataagacgaagggccacggtacaggccggtgcctgcgcatttggtgcacttgtcgcgatacagcttcacttccttccgggagttcgggcgggcacccatggacacgtcttccagggtcttcggcgcttcgttgttgatctctacggtagcgaagtcatcacccaggtcttcgaagccggtgaacagattctctgctgcgttcatgtcgattctcctgtttggaaagttcgtttcgatgagttgactatacgccagaagtggaaaaacggtagcgatttctcactaccgttcgtcgggtcgaagacaatcaataaatgtcgctattgatcttgaacccatgctcagcgccgtcgttgtagtcgtactcaacataactgtcgcagtagtcgttcaaatgctgaatgatgccaagaacgtcgttcgcggccttgtgccttttcgcggcgatggtcttggcgatgctgtcgccgacttccaggatttcggccgtccggcgatggatcagcaggcgactccaaagatagagccggacgcgacgaataatgtcgcgatggcgctccagtcgtccgtgcaactcttcaatttcgtgctcgcgagattttaatactcgtcgaagctgttgaacttccaactccaaatcggccttagtagccatgttcacctcaaaaaggaaaatcgtctgggactccaggaagttcgacgattattgttgagcctgatcggtctagaatgcatccgaccgagccagccctgtgtggatagggtctacacgaactataacaggtgacttccctgactattcgccaggtcgatcctccacaccatctgcaaattggcgggcgcttcgacttcagttttcgttcgtccaggacggcgcgtctgtcgcaggaaaggcagcgtgccttaaccgacgtaaccatgggtatagtcgatcattcggatgagctcatcatcctctgattctctcgacttcagaccgcccaaagagtccgactggccgtcgcatttcgcatcgatatccatcgaagacaggaatcctgccgatgctgcgatgatatcaactttgtcgccggccttcttgaagccttcgcactcagcatcgagggccacaattgcactcgcggccatgttcacatgactgatgaggtcggggaagatcacaggaacttcacgcgacatgccacggaccgtcagcttcaggactacatacttcatactcactatcccttttgtatgtgaggaaagaacttgctgttttccggatggtgaaaacgctcggtcgcaggcggtctttcttccggacattgaatcgtcgaaggcgggaaaaccgcgccggcgataatcgccgcgaggagtgcagcggatgtcgacatccagagggcggtttccaggctcacccgaacttccggacggcgcggcttcattcgctccaccctcttcccggttcataggatggtagactgccgccgcgaacccagttgtcccacatatggttcagaccagtcggtggctggggtggcggactgtagaatccgggagtctcagtgctgctcaggaaataaggcgtgcaaacggcctggacgaccaattggtgccgctcccacatcttatcaatcgctcttagcatgacgtcttcgcactgagccttactgtcgaaccgtctgctagtatggtccggcatctggacgcagccgtctccagtgcaaaggaaagcagtagcaatccatacggtgatactcgccatttcgtcaccctctttagttgatgagcagagtctattccatctgctcgccaggagtaaagcgcttttcgtcgggataaatgccgatgatgtctgcgtcgagcatccaaatctccacggacggatcgtcgctgctgatgtggtacaggttgtacagctcccgtccgccgacagcgcgctcgcctcgcggctcaaccgccagaaccttgccgtgcccttctccgtgctcgtccaggtatatgacgtgatcgccgacttcatagctttctttcgtgacgaggcgtgaacgcgagctgttctgcgattccaccacccaggaatccagcacgccgcctttcatgtcgcgaaacaatcttgccgatttgtcgcaatcgaatacgcccagaacttctccgtctttcaacacgatatgtacgattggcaaaagagtattcatgtttaatctccattggttgataattagagtctaatctgccgaaaagttcccgtaaagaattattttctcataactgattagttgcaactgttaatctgatgtatatgtttgaatctcttttgaacgtttgatgtttcccctataataagcgcacacagccaacaaccacgtggaactacaatgtttaaactttcctggatattcgggcgcaaaaaggataatgctgcctgttctgaatcggcgccggagaaagtcgcacaaatccctcaacacgatccgctcgaccccatgatcaagctgggaaggattcgcggctggaacgtcgagccggagaaagccccggtcattcgtagtgtgaaagatttcctggaaccgggcctatctgtcgcaatggatagtgcgtatggtgatggaccaaccccggccgcgaaggctgctgcgggcggccagaatccctatgtcgtcccgactatgttgcaggactggtacaattcccaagggttcatcggataccaagcttgcgcaatcatttcccaacactggttggtggacaaagcttgttccatgtctggtgaagatgcagcacggaacggatgggaactcaaatcggacggcaggaagctatccgatgaacaaagtgcgctgatcgcccggcgcgacatggagtttcgcgtcaaagacaacctcgtcgaactcaacagattcaagaacgttttcggcgttcgtatcgcgctgttcgtcgtggagtctgacgatccggactactacgaaaagccgttcaatccggatggaatcacgcccggctcctacaagggaatctcccagatcgatccatactgggcaatgccgcagctcaccgctggctcgacggcagatccgtcttccgaacatttctatgagccggatttctggattatcagcggtaaaaaatatcaccgcagccacctagtggtggttcgtggaccgcagccgccagatatcctgaagcctacatacatcttcggcggtatcccgctcacccagagaatctatgagcgcgtgtatgcagcggaacggacggcgaacgaagccccgctgcttgccatgtcgaagcgaaccagcaccatccacgttgacgtggagaaggccatcgcgaacgaagaggccttcaacgctcgcctggcgttctggatcgccaaccgtgataaccacggcgtgaaagttctgggaattgacgaaggcatggagcagttcgacacgaacctggccgacttcgacagcatcatcatgaaccaatatcagctggtcgcggccatcgccaagactccagccacgaagctcctcggcacttctccaaaaggattcaatgccactggtgagcacgaaacgatttcttatcacgaagaactggagtccattcaagagcacatattcgacccacttcttgaacgccactatttgcttctggcgaagtcggaagaaatcgatgtgcagctggaaatcgtctggaaccctgtggactccacgtccagccagcaacaagccgaattgaacaataagaaagccgcgaccgatgaaatctacatcaactctggcgttgtgtcgccggatgaagttcgcgagcgtctgcgtgacgatccgcgttccggctacaaccgactcaccgacgatcaggcagaaaccgaaccgggcatgtctccggaaaacctggccgaattcgagaaggccggtgcacagtcggccaaggcgaaaggcgaagccgagcgagccgaagcccgggcgggcgccgtagagggcgcaggcgcccctgttcccgccgctccacgcgggactaagcctctcgcgaaagcggccgaggaaggggccagcgaggtcgctgaaccgccgtcgcggccggaccccaaggccgagctgcggaacttgttggtcgatcttttgtcgaagctccaagacctggacgacattaaggcaccggatggcgtagacatagagcacaatgatgcgcctggcttaaagcgcacgtccaaacctggcgtgtctggcatggagccttcggtgttttcgtctaaccgcatcgtcgggcctcgtgatcattcggaactccagagaatcaaggtgaatggaataaccaccttgatcgaaaatccgcgcggaagcattcggcaaggaaaggatgggagttggcgagttcagatgaaacaccactacgggttcatcaagggaacgaaaggcgctgatggggatgaagtcgattgcttcgtcggtccgaatctgggatccaaacgggtcttcgtcgtcaaccaggtgaacaaggaaggtcagtttgacgagcacaagtgcatgctcggcttcaacaacatcaacgatgcgaagtctggatatctgtcctgcttccgtccgggctgggatggtctcggctccatccatgaagttgacctgcccgctttccgtcgctggctggcgagcggcgacaccaccaaaccattcgggggcgagtgatggcattcaaggcctccaaaaagcgcgagcgccgggcacctcttccagtcggaagagggaagcccataattccatcagcaggaatcgaggcctggtatcgaaagcagatgaaggatatttccaagctcatgatctccgactatcgaaacgagattgagaaggcgctgtcccagcctgcggccgaacggttcttcgccagcgacgaatccgtgaacgtcctgttccagatgacccttcgaagcctacagcagcgatggagccgcatttttgaaggcttcgcggccaagatcgccccggagttcgtcaaccggaccgaagaagccgccaccgccgcgacccttcacagcttgtcggtggccggcgtcgatcagccacgagctgcgtataatgagagcgtcaggaacaccctggaggccgcaaccacttacaatcatactctcatcaccaagatccaagaggaagtccacgagaagatttacacatcagtaatgctgtctctgacttccccgaatccggaagagcaaggagcttccggcataactaacgcacttcgcaaagtcgggaagttttctgaagatcgaatcgaactcatcgcaagagatcaaaccagcaagctttacagttctctgagcgatgagagaatggcggaaaatggcgtcgaggagttcgagtggctacactcttctgccggcaagactcctcgccacacccacctggagaaagatgggaagaggttcaagctgaatgaccccagactttgggagggtccgaaagcagaccaggggccgccaggatgggcgattaactgtagatgcagaaagataccagtcatttgacatcgataggagcgctatatgccgttagttcatggcacttccaatgaggctcgttctgaaaacatcaagcgggaaatcgaagccggtaaagacccaaagcaggctgcggccatcgcttattccatccagcgcagtgagaaagggaagacggcgaaagattgttcgcctaagctcgtcgccgatcttcgcgccctggtggacgctctgtcgaggctcgtgaaatgaaccgcaagacgtgccggcgccgactcgtggtcgatgtaatcagggccaatattcacggcggattcttcagcctgaagtttgccgccatcgatttggcaatcatcggcttcgccatcttgatggcttttggccgataatgctgagaaaatctggattctgactaaaaattctagtccggatagccgcaaattaccgtttacggaaaatagcagtaatttggaaatcctactgccgcgaggctttaacagagccagttcctaatttccgatttagccgcatgcttcaaaagtatatagcctgggaaattagaagtaacgttccaatagaattcatctataagtaacgctataatataacgtcaatctatatactctagacgtattgaaattcaatttttaatcggtaaattggtaatttgaattagtttaggagttgaaagcctcgcggcagtaggcttagacaaatcccgtcaagtttccgagaccaaattaccggattttcgcggctgaggaaactggtaattagatcacaatacaaattataatgtaagttaacagtcgcggctacatctaattattattccgcttatttacccttagatgtactgcgtatataatacagccatagtccacgactcttcgaattaacgatggcaaagtcgaaaagaaaaattgacgaaaatggatatatgaccatagagggctgcccgatcagctcttatggcgttttccaatattctgctggtcaactcggtcttccgggcgatccgacgcggattgtcaacgtatatcgcccggagtctgccgtcagcgatccggagtacatcgaatctctgaagaatctcccgttgatcgacgagcatgagatgctgtcgggattcgacgatgatgacgatagcgtggcccccgaagacaaaggggtggagggcatcatcacatccaacgcttactacgaagccccatgggcacgcggcgatatccgcatctattcccgcaacatgcagaatcagctggaaaggggcaaagaagacctgtccctaggctatagttgccgctacactgagcaacccggcatctggaacggaacgccttatgaagtcgtccaggacaagatgcgcggcaaccacattgccctggtaaaagagggtcgtgtgccgggggccagagtattggatggtctgtgttttgaccatctcagttttgatttcagaccatccgatgagggtaatgaaatgagtctcaagaaagccaagcggaagccccctgtccagcgcgtagggcaagctgctgactcggcggtcgaagagttgcgcgccctgtggccgaagctatctgcgtctgtccagaagttcctgggcgaagaagagcaggagccggagcatcaggaaggcgcagctccggccgaaccgaccgacagcgagcacctgaccgagcatccgactctggaaggtgctcagaaggatgacgaagagcaggaagaggagccttccgttgtcgatccggccgtggccgccgtcgagccggagcatcaagaaagcgccgcatccgaaatgtccggtgaaggcgaagtcgccgaactgatctctcaggtcaaagccattctggctcgactggagggcacggtagccgaaggggcagacgaagagcatggcgaaggtcaagatgtcgtcgagggcttggaggagcagagcagcctcagcggctcgcaaaccgccagcgacgatggtggtgagagcaaggataacagcgaggaacttcctgaaatggcacagaagaacgcgcaagatgctgcaattcgcggtctctatcgcgacattgctgctaaagatcgcctctacaagcgtcttagctccgtggttggtgcgttcgatcaccgagctatggactcggctgaagtcgctgtttacggcgtgaaaaagctgaacatcagctgtgcgaagggccaggaagctctggcgctcgacatgtacctgaaaggcgtcgaagcctcgcgcggcgcggccagccgtcaatcgaaagcccaggattcggccggttctgctccgcagtgtgccgagctggacagctacctgaagggggagtaactcatgttccagaaacaagtttaccgccagtacactcctggttttccgggcgatctgatcgaggacggcccgaagcgggcgcggccgggtcgaatcatggctctgtcggccgtaactccggctgccaccgccaccggccccaaccgcatcagtcgcgctttcggttatgccggtgacgtcagcgccctcggcgaaggtcagccgaagaccatcgcggctcgtgcttctgaagtcgtgatcggcggcgccaacttctttggtgtcctcggtcatccgaagcactatgctctgttcggttcggccggagactccctggctcccagctatgatctgcccgatggcgccgaaggcgagttcttcgatatggccaccggcctggtcgtcgaaattttcaacggcgccgcaaccgccctggacctggactatggtgacctggtcgcctatgtccccaacaacctggctaccgccgacaacgcgcttggcctgccggccggcgccctggttggcttcaaggctggctccatgccgaccggcttggtccagattcccaacgcacgcatcgttaacgccatcagtctgccggaccagtcggcggggaatctggttgctggcgttaccatcgtccagctcacgcagtaaggaggcgtcatgagccagatcagcaagacccattcgcgcctcgcaggccgcaatgcgaaacctttcgacctgaaaaacatcaccaatgacgccgtggcgtctctgcgccgcatcggcctggtattcgatcacgccgtcgtccaggaccagatcaaggccttggcgaaggccggcgcgttccgctccggctcggccatggacagcaacttcaccgccccggtgaccacgccgtccatcccgactcccatccagttcctgcagacctggttgccaggcttcgtgaaggtcatgaccgctgcacggaagatcgacgaaatcatcggcatcgataccgttggctcctgggaagatcaagaaatcgtccagggcatcgtggagccggccggcactgcggtggaatacggcgaccataccaacatcccgctgaccagctggaacgccaacttcgaacgccgcaccatcgttcgtggcgagctgggtatgatggtgggtaccctggaagagggtcgcgcctcggccatccgtctgaacagcgccgaaaccaagcgccaacaggcggccatcggtctggaaatcttccgcaacgccatcggtttctacggctggcagagcggcctgggcaaccgcacctatggtttcctgaacgatcccaacctgccggcattccagaccccgccgagccagggctggtccactgccgactgggcaggcatcatcggcgacatccgcgaggccgttcgccagctgcgtattcagagccaagatcagatcgatccgaaggcggaaaagatcaccctggccctggccaccagcaaggtggactacctgtcggtaaccacgccttacggcatttcggtttcggactggatcgaacagacctatccgaaaatgcggatcgtgtcggctccggaattgtccggcgtccagatgaaaaaccaagagccggaagatgctctggtgctcttcgtcgaagacgtgaacgcggccgtcgatggcagcaccgatggcggcagcgtgttcagccagctggtacagagcaagttcatcaccctgggtgtcgaaaagcgggcgaagtcgtacgtggaagacttctccaacggcaccgccggtgcgctgtgcaagcgtccgtgggctgtggtgcgctacctcggcatctaacagatgcctattcaccaaaggccgggcttccggcctttgttcactctgactctaactcggttgtaggggccggttagggcataattactaggactacgccaatgactgtttatatcgtttcctccatgactcaatcggtgtcttacaatgcgtatgacacctctgatccgtccaatcctcgcctccagcgaaagattctgattcgcggccgcgccggcatcgcatcagaaacttccggcttcggcgacatgatttccgacgcggccgggcgtccgatctggaccccgcagggcgattgtactgccgtgagcgattcggatttcgagctgctccaggccaacaagattttcatgcgtcacatggataagggttatctgcgagtcgtgaagaccgacatcaccagtgaccaccagcggatttccaaagagactcgcaccatggagcgcgatggattccagcctctggacgctgctcgtctgcagcagaaaatcaaggtgactaccgccagcgcttcccaggaacaagagttccggatttaaccgagggtttcggtatggtgattttcgacgaacataagtttcgcacgctgtttccggagtttgctgatccagccgcttatccggacgtgcgcctgcagatgtacttcgacattgcgtgcgaattcatttctgatcgcgattcgccataccggattctcaatggtaaagccctggaagcgtgcctgtatcttctgaccgcccacctcctgtcgctgtccacgatgcaagttcagggcgcggctggaggtggcgtcactgccggtgggacccagggcggtttcatcaccagcgctacggtcggcgaggtcagcgtggccaagctcgcgcccccggccaagaatggttggcagtggtggctttccgggacgccttatggtcaagagttgtgggcgctcctcagcgtcaaagcggtgggcggattctacatcggcggtcttccagagcgccgaggcttccggaaggttggagggacgttctggtgatccctggtgcgaatcttctgcgaatggccttcggggtcatcggtactcaaattgtgaaatatcgcaagtttgagcagcgagttaagaatgatcaagctcagtacgtttccatgttcgaggagcctttcgacctggcagcgtctgttcagcgagtccgacgcgatcagtatgtccagtttaatctggagttccaacggaattacgttatgatcttcgccaactttgagatggttgacttggatcgtgatgtggccggtgaccagttcctctggaccggaagagtctttcagctggagtctcaaggctcctggttttatcaggacggctggggagtttgcctggccgtggatatcggtgcggccaagctcactgatgacgggaaaccgactttctaggtgatgtatgtttgacggcgaactgatagcgaaactggttgtcgagttgaatgcggcgatgacatctgctcaagaggctttgcagttcccggattttgaagtcgtccagaaagctcagccgacccaacagggaacgtcaaccaggccgaccatctttttccagaaactgtttgacattcctcgcggctggcctgccaccgattggcacctggacaacacggcccgcaaatatgtagaaataactcgacagcatgtagagacgactttccagatcagttcccttcattggcagaatcctgaaataactcacgtggttacggcttctgatatcgccaactatgtgagggcttatttccaagctcgatccacgattgagcgcgtaaaggaactggacttcctcattcttcgcgtgtctcaaatttccaacgaagcattcgagaacgacaatcaccagttcgaattccacccaagttttgacatggttgtaacttacaaccaatatattcgcctgtacgaaaacgcagcatattcggccgatggggtattaataggcatatgagtctgaggcgcgattcagagctaatcgccgcgcacctccagatgttaagagccatgcgcggcaggtccgtttcagccggatggtattccacggctcgatatcctgacaaggcaggcggatcggtcggaatacaagtcgcgagaatcgcacgtctcaatgagtacggcggaactatcgaccatccgggcgggaccaggtatattagggacgccattgttcggggccggtttgttggcgttcggttcgtcagaaacgactttccgggagaaaccgaggtaactaagcctcacagaattaccatcccggctagaccgtttatgcgatatgcttggaacttgttttccgcagatcgcgccgcaatccagaaccggatagccatgaggctggccagaggacagatcactccagatcaagctcttgcccagatcggcctggcgttggaaggatacatagccagaagcatcaggaccgggccatgggtggctaactcagcatctacggtcaggagaaagggattcaacagaccgctggtcgatacggcgcacatgcttcaatcgattagcagcagagtaacataaccaggagatcatccagtgatcagtcagagccgttatatccggatcatttcgggcgtaggcgcaggcgctccggtcgcaggccgaaagctgattctgcgcgtcatgactaccaacaacgtcatcccgcccggaatcgtcatcgagttcgacaacgccaacgcagtcctgtcatacttcggcgcgcagtcggaagagtatcagcgggctgcggcttatttcaaattcatcagtaaaagcgtgaattcgccgtccagcatcagcttcgctcgctgggtaaacaccgccatcgcgccgatggttgttggtgacaatctgccgaagaccatcgccgatttcgccggcttctcagcaggggttctgaccatcatggtcggcgcggccgaacagaacatcaccgccatcgatacgtccgcagcgacttctatggacaacgtggcgtcgatcatccagaccgaaatccgcaagaacgccgacccgcagctggcccaggctaccgttacctggaatcagaacaccaaccagttcaccttggtcggcgccaccatcggcaccggcgtcctggctgtggcgaaatctgccgatccccaggacatgtccactgccctcggctggtccacctccaacgtcgtcaacgtcgccggccaggctgccgatcttcccgacgcggccgttgccaagagcaccaatgtcagcaacaacttcggttcgttcctgttcgccggtgcgccgctcgacaatgaccagatcaaggccgtgtcggcctggaacgcggctcagaacaaccagttcatctacacggtcgcaacttccctggcgaacctcggcactcttttcaccttggtgaatggaaacgccgggaccgccctgaacgtgctgtcggcgactgctgccaacgacttcgtggagcagtgccccagcgagattctggccgccaccaactacgatgagccgggcgcttcgcaaaactacatgtactaccaattccctggccgcaacatcaccgtttccgacgataccgttgcgaacaccgtcgacaagagccggggcaactacatcggcgtcacccaggccaatggccagcaactcgcgttctaccagcgcggcattctgtgcggcggtccgaccgatgctgtggacatgaacgtctatgccaacgaaatctggctgaagtcggctatcgctcaagcgctcctggacttgttcctgaacgtcaatgcggttccggcgagcagcactggcgaggcgatgaccctggcggtgctgcagccggttctggacaaggcgaccgccaacggcacgttcacctacggcaaggaaatcagcgccgtccagcagcagtacatcacccaagtcaccggtgatcgccgcgcctggcgtcaagtccaaaccctgggttactggatcaacatcaccttctccagctataccaacagcaacacaggcttgaccgagtggaaggccaactacacgctgatctattcgaagggcgatgccatccgcttcgtcgaaggatcggatgtgatgatctaatggtttgcggcggactcgatccgccgcgaccttccataaatggagtgaggaataagcaatgatcaacatttctgcgttcggctcgatctgccagttcacggcaagcagaactttcccgaacggattcaccgtcaccgagtttgccgacgatgcggaccccatcgacagcccgccgttcactgcggccgataccggcgtcggcctcaacggtgacatggtagtctggaaccgggcgaacatcctggaagtcgtcgttaacgtcattccgaataccgagggcgagcgcaacctggcagtcctgctggatgccaaccgcaccggaaaggacaagtcgggcgctcgtgatgtcgtcggcctggtcgtggcgatgccggacggcagcaaaatcacctgcaccaacggcaccccaatcgacggcgttctgatcaacgcggtggcaagcgtcggccgtctgaagaccaagccgtatcggttccgatttgaaaaagtgatcaaagccggtactagctgatgaagaaaattccgctgacagcagtccccaatcaagcgatctcatttaacgccggtagcagctattggaagattcgcctgtaccagaacatggacatgatgaatgccgatatcagccgcgacggcgtgatcgtttgccatggggttcgctgcttcggcgggattcctcttctccagtacagccatcagtaccgacctgactatggcaatttcgtcttcgaccgcgacgccgattggacattgttcggcgacggcatcaacctgttctatctggacggcgccgaattcgccgagtatcaggcgcttgccacgaggaaagaatgagcacatcaacgatcagaaccgggacgaacaacgatatccttttggacgacaatggaaacatggttatcctcagggatgtcgaagcgtgcgcccaggacgttcgggcggcgatgctcatgcgcaccggcgaaaacattttcgatgtgaactccggcgtgggatatttcgaatacatcttctcgccgcagaaaagctatgatgacgctcgcaaatccatcgcggatgcaattttatcctcgccggatgtgaccggcatcgagcagcttgacatcgacataaccggggaagtcttcggcgtcgatgcgaaagtcatcaccatccacgggcctgttaccacaggagtttgaaatgagtaccatccgcatccaatacgccaacggcacccaactgttcctggacggcaaaaatccgccgcccctggacccgctgccctcgtttaacccgtctgtcgaagatctggaaggcctggaccgcgaaaagaacatcgacaagggcgactcctcgccggccggtcttcccgttcccccggtaaacgtcgattccaatgtcgacaacggcggaaccatcccggctccggtatcgaccgacgctgctgcggccgaatcggccccagaaggcgcccaggaagctcctgcagcaggccaaggcgacgagaaaggcgccgaggaagccccgactacagccccggtagaaaaggccgaggaaacggcctcgccggccgctgaagaggaaaccccggctcccgccaaggccacctctcgcaaaaccaccagcaagtaaggactcgacatgatcaacgtcagcggcttcggcacaggaattgtaatagtttcagcctcatcgttcccgatggggttttccttgtcgaagttcgctgatgatgagagtccgatatcctccaaagagctggagccgttcggatatgagatgctttatgacggcggcctattcgcctttgacaaggctgctcctctggaagtatctgtatccgtcatcgcagggagcgaggatgatattaaccttcgcatccttctcaattccaaaaagggatcattcagatttcttccgggcagcatcccggatatgacgactctcgtggccactcttcctgatggcggccgcaccgttctgtccaatgggactatcatcaagggtccggccatcgacaccatacagaacaccggacgacgcaaaggcaacacgtacacttttgttttcggtagctatcttggcgcccagactgcgcgtcaagccatttctaacgttatccaatcggtgctggaggtggtctgatgttggggattttcaccagcctcctaagttcgcgatctttttcgattgtggaccaaaacacaaaccagctagttgctgcggatttgaggataagccgggtcaacacccggttttcttctgtagggcaacgccacatgctggaagatggtacgaccaagatggattccagaacgatccaccctatggaaatcatcgtcgaagtattttgcccttcaattgatgtcgtcgatcagatcaatcaattgctcctggatcgcgacacactgtacaaagtcatcactcgcggcatggtattcgaacggatgatgtgtaccagcgaagcgctcaatcagactccggatatgatatcggcgactcctgcgcggctgacattctcccaagttctcgtccagaatcccaagcctataatgttcagaaatgcaggggactcttctatgatcgaccgagggctggccctagctgaagacgtggttggctcggccggcgatctgttcgactacgcagtaaacggcgtccagaacgccgcagacttgttctgaggtgccaattgaactctttcctcaagtctattctcaacacgcctactctcaccatacgcaatgatgttaccaaacttcctgtctggaagagtcttcaagtcaagaaagtggaaatttactcgccggcttccgtagtgtcgaaacctctggcgacgaaagaccagacggaagctcaagtgtacaccgaagctctggacattgatgtgaagaatggaaagatcatccaaccggtgcgactccgcatcaatgctatctgtccggacctgtccaccgttgaaagtatcatgaacgctttcaatgataacacctcgactttcgctatcacttctaagtcgatattggccgataaaatggccatcatggcgctcgatgtagatcagtctccagacatgttgaacgcggctgagatcaatatggaattcgagcaggttgagcctccagtattgaatgaattcgatcctgcgttccctcaagatagtccgacttatggggtacagattcaatctctttctgatgctaatttgctggatttgggcgccatcggcgattcgatatcttcggccgcaaaatcgctatataatcgcgtgaccagctacttctgaggatgtatcatgcttgaaatcaatcttcccgatggccgtcaaactcgcgtacaaatcgaggcgtggtcggcattggatggctgggacctccagcgccgtttcgtcgaattcgctgtcagccaagattccgacttccgccgctctttcaccatggaaatcctgggctatgcgaaagtgctgcttggcgacgatgacgccggcattccgctgaccaccgcggcagtcatcaacaaccacctcggccactggaagaacgtggaactggttttcaactctgttctcaagcacaatggcatcgacccggccacgcacgccgaccggccggactattgggaacaagtcggatcgcagatggccatcgcatttctggccgaggcgtccaagctcattggtccagcaatgaagatcgccgaaggactcgccaacaagccggagtgattcatgtctagtgatttggatgaattcatacttcggtatgaggccgatactgccagagccgagcgcaatctggagcgcctccagaaccagatcaggcgcgtgaacagcgcatcgacgagtggccttcaggatttgcgccacttcgcagacggcgcggccaccgaactcggcagagtcgttccgcagattgattctgtgacgagcgcaattcgcggaatgaacgcgcaactggcaataggcgccactggcgtggccctggtcgcggccggcgtcaaggcgttcatgaacaccagggaccagtacaatcagcagcgcatccaggcgatggacatcggcatcgccccggcacgcttggaagagtaccagagaaaattcgttcgccagtccggtggaaccatcagccgcgagcagggcgcggagatgaccaaaaatctggcagacactttccggcgtgcttatcgcgatatcgggcgagtcggcccggaagcgcgaattctgcgtatggccggcgtcgatgtcgggagcttccaaaagggcatgcggccgctcaacgacatcatcaccgatctggccacgaaaatggccaagctgaagccggacgaaatttctgcctacgctgatgcccttggcgtctcgcgagattacctgagcaccctggcgaagatcggcccggccatgggaaaagtcactgagatgacgactgcggaactccagtccagggtccagggcgagtccaacatccagaaattcaacgatgccctggcgaatctcaaccagacgttcactaccctggaaaaccgagtcggcgaaaagctcgcgcctgcgttcaccaagctgatcgaaatcatcgacaagatagtccaggctattcccaatgaagtggaaagcttcgcgaaggacaccaaatcccgttgggaagatggagtgctcgggaaggcgaccgttggcagtgatatcctatccctcctcagccccggcgccctgctcggtcgcctggcagcgtgggggactcgtcgcggcatggaagaatcagggctcatcgacaaggacaaggttcccggcgctcaaaccagcgaagacctggccaagaaacaagaagaccaggacaaggctactaagtccatgaaagagctagagaagctggctgaccagaccacgaagtctaccaatgattttgcggtggcgatcaacatgttcagtggcgcggtatcgtcgttcgcgaatgccgttgacgagcgccaagcttgggcagcctgggcgggggaaattggtcgggcggtcggcatgggaagcaccgcgccgacttcgcgggccaccggcgtctatccgcacgcgatctatgatcagtcgaagagtggcgcggccggacaagtcttcggcgagccaatcggcgcccagtctcttcgcaatcgcatgttctcgccgcagcgcaaggcagagccggtcaccgttccatcgtacatcaacgatatcatcaaagatgcttcgaagatgtacaacattcctgagctggacatcaagaaactcatatacaccgaaagccgattcaacgccagggccaccagcgaagccggagcgaaaggcctcatgcaactgatgccggaaatcgccaaggcgtatggtatcactgacgtatatgaccctcgccagaacatcctcggcggaacgcgcctactgcgtgaaaacctagatcgagcaaatggcgacatgcggttggccttgacatactatcatggcggactcgatccgaagaactggggcccaaggactcgcgcatatccgggtttggtaatgagcgctccaatcgagctgatggaagaggctcagcgcaagcagaaggctgcggccatgaccgtcgccaacgagacgttcgccccggaaggcggcgacatggacattcgtccctatgatggcgggcgactggaaaccccagaccagggcaagaaggaagatgagcgccgcgaagcccgtcgatatgacgacagggttgtgcgaccggaaattcgcatcatcgaccgcatgccagaccgcagcgacggcgaaatcctcaagatgtctaggcgtcaagaggccgaccgggcagactctggattccggaagttcccgaatcaggttcgcggcgagaccaagcagaacatccaggcccaactcactgccggagccatcgcgcaagtgatcggcgttaaccccaaccagatcatgcgccgcgaaatcagccgttctgacttgctattcggatacaaccaagccatcctgggcaagcagcaggagatcaaggccgccgcgaccgaagccaacaacgtattcctgtctccagccaagctcgccgaagccactgccaaggtgaacgccgcatcgcgagaaatggatattctcaggacgtacggcgagcaacttctgaagagcgctccagagcgcggccaggagctgaccatcggtcgaatcgatatgttggtcaacgttaccggcgcgaattctccggaagaggctcgcgagatattcagcaagcagactgcagaccagctgactacggcaatccaagatgcccaaaacgattccgcaactaagatactctactgatgaaaaagagaattctgcgagtaacattcaacatgccttatggacccgaagtcatccgagaggatttggatgttcgggtccggatcatgaaggctgcgttgcggattcagaaccgggcgactatggaaattttcggcctaaccactcagctgcgtgagtctcttctgtcacagttcaccgcgtggaagcaccggcaacgtcaagtcggcagggaagacgaattgatgatcaaagtgtcggtggaagccggctactctgaccaggggcgcgagcaagtttccagagtctttgtcggcgaagtggccattgtcgatatcatttcgccgccaccggacattggaatccgcatccagtgctacaccaggcaaatcgacaggacgaagaccattcgaaatatgccgcccgccaacacgacgttcgtcaagttcgtcgagtggggcgcgaacgaaatgggattgaacttcatctgcgataccagttacaacgatcaagttctgaagaatccgggccggtctatcactgtcgcgtcggcaatcctggcgtcgattcaggatatgtacatgccggacgtggccgcgttcgttgatgatgacatcttgatcgtgaaggatcgcgataaagtcattcgccctgatgaggtgaccaacgtcaattcgttcgttggaattccatcttggtctgaatggggcgttgaattccagtgtctgtttgagccatcgattcgcgtggctggaggcgtggcggtcgaatcgctcatgaacccgagcgtcaatggcaactatgtaatcactgctctggaatacgatttggccagtcgggatcggccgttctatatcaaagtcatggggagcccagcagcataatggccagggaaatcaaaccgttcaacatgttcggcgttcactatacttcgcggcaattctctgctgtcgatgggctcagcatgatgtcggaaattcagagtgtgccgccagaagaactgctcaagggaaccagtgtattggcgcatccggaagaccatccggaaggcatctggcttccattgactgctgcgaacatcaatctttatgtcgttgatcgagcgaaagtaatagctcccgtacaagttcttgcacttctgtccgaagtggtaatcgactggaactttggttttctcaaagactggaccggagtcaagattccatccagatttgtcgaagatatcaaaagcgtgaagacggcacattcaccttctgtagttgcgagcttggtcgcgaacggctcagcctctatgcgcgagttggaagagtattattcgactcaagatgcgtttaagatgatagacatcatgacggcgaagagcgtgaacgaggccttggcgtccgaagcatcgcacaacagaatcaaaaagggataattcctaaccgggcctgggaaggctatactagacctgccaaatcagaggctttcccatgtccaatatttctctaacatccgcaaaagctcccgacaggacgcgactgatcgccgctcttgacgctcggtcgcggcgggatgctctagatttcgaagtaatgataccggctcaggttgttcaatatgacagggccgagaatatcgcgacgattcaacctctcatcacctgggttgacacggaacacaacgccgtccaaaggcatcagctggttgatattcctgtaatttccatgggggctggcggcttccacataagtttcccgattcagcaaggtgacataggctggatttatgcggccgaccgcgacacgtctcagttcctggagtcgttgtcaatgtcgaagccgaacaccggccgcatccataagttcgagcatggcctgttcatcccggacgtattccgtcgatacaccatcaattccgaagattcggccgctatggtcatacaatcgacttccggagcgaccagaatttcgattcgcggcgacaacatcaagatcactgcgccgtcgaatgtcaccgtggatactccgcaggcgaatttcactggaagtgtgactatcgccaacaccctggttgtaaacggcgtcaacgtgaacaaccacggccacctcgaaaacaacccgcctgatgcccggacgaaaggcggcatgattgcttaaggagattttcatggcaagttttgatttttctgatttaacagcggggggggggttgtaatggctaactacaactacatcgtcgatactggtgtgatagtcgcagataccgccgacgttctgagcgacgttgaggccgagttccgcgccgccctcggtgccaatatcaacttggccgcgagcactccgcagggatcgcttgtcgcggccgaggccatcgcccgttccagtgtcatgcggaatgaagcgcgaattgccaataccataaacccgaacgtttcattcggaacgttcctggacgcgatctgtgccttgatggggatcgagcgcggttctgatctgtcaaccttcggctatggagttcaagtcaccggccgcagccaaacccgcatttccaccgggtctagggtccagactccggccggcgcgatcttcacagtgatgagcgatgtcacgatccctgctggtggtgtcgcgaccatcgatatcaaatcgcaggagtatggcaacattcctctgccggtcgggaatctcatcatcatcgacggaacaattggatggtccggagcaaaagtcatcgcctccactcgcgtcgatccgggcagccgccaaatgagcgatgcagagttgaagaatgcccgcgttaatcgattggccatccaaggccgcaactcgactatggccatcaaggcgtatgtgagcgccgttccaaacgtcacgtcggtgaacgtaatcgagaacaacaccggcgccgttcaagtggtgaatggagtctcgtttacccttccgtatgctgtttgggtctgcgtcgccggaaacccggataaacaagcagtcgccgatgcgttgtgggccgcccataacggcggaactccatgggactatggtgcgacgaacaacggcgtcccggtggacggtccgaatggcgttcctgtgcgcgatccggcgtccggtcgaaagtatgtcgtgaagtggaccaccccaatcatgtacgatggatatgttaacgtaacagtccagcaaggttcctcctctgtagctccggaagccattcagaacgcagtggtcaattacacccaggggaaagtggaaggggaagagggactggtggtgggcgcgagcctgtcggcattcgaagtcgccggagccatcgctcgcgaaattcccggcatctacatcaaactctgccaggtcgcgtgcgtcgcggctggctcgccggctccggctccgggcgatttcacttcggaatacgtcatgagcgcattcggccaggctaccatttccgttggtaacgttcgggtgactttcgtatgactctgcctgcgtacaattcggacatccaacaagctctgaaatggctccataaccaggcgcctggaatcaccggcctgatccagagaaaggcgcaatggtatgacagattcagccgccaattctgggccaactgggagcgcgacgttttcaacttgaagaccgccaacccgttcggccttatggtttggtgcatcatcctcggcacgccttcgaaagggttcggcctttatccaaagaacagttcttgggcattcggtcggctacgccagaacttcatctatagcggtacacaagtcccgccaccggcagacgcatcgcctggaggcaacttctacggtggcggcaatgccgaaattctcaacttggacgaaatcaggaaagtgcttcagctaagatatgtagcgctgatttcgaacggctcgattgcatatatcaatcgcatgcttcgttacatattcaatgatgatgagccatgggacgaggcgaccggtctgtacttctatctcatggactcaaccggcgagaatggccctgtggagaacttggcagtatatcggaaagattgggaaggtatggtgttgttgtccagttcgcccagaacgaaccacgtgctgacatcgacccctgccagcgacgccgattggccaggagtcgatccggccgcgagcggtcttccggtaacggtcgaaacggcgtccgctacggccccggacggctccgctacggcgtgcaagcttactaagccggccgggagtaccgcttacgtctccgcgccgatagatgggccgctggggtccggtagcactgtaacgttctcgttcttcgcgaaagccggctccacccgtttcattgcaattcagtcggctgccgatttccccagtcgagccgatgccgttttcgacctggattccgggaacgtgatcagcgatcagatgttggacagcagcgtggtaagcgcccgaatgattcgtctggagaatggctggtggcgttgcgttctcacgaccaagaccgtcagctcttcgttccgcgcggcttacatcgctccggcagaaaccaacttcagctggattgattcgaattccagcgcggcgattgacgtgcttatctggggcgctcagatcgaactgggtgatactccaactggatacttggaaactaccggggcgcccgtaaccatgaccgattatgttttgcagaacgcccagaccggaacagtcaagttcacacagccccttccgaccggagtagaagcgtattggactggagactggaaaggcgggactgcagcagaaccggccagattcgcagtcgggaatgggactcaagatacattcaatctgtccagccctgcatacatcggcctacccactagtggggcgttcaagctagaatacagagttggtccggcgcttaatttgtcgccgcaattgatcaacctcatgaatgaccgggcggtcggtatcatgccgacttgcgccggttgcgatgtaaaagtcattcaggagtaatgacgtgatcacacccgaactgatacccagtccgtttgctgcgcagggcgacaaagacccgatcccgcagacctcttccactggttttgccaaccttcgcgacggctacacgccggactatgaaatcagtctggcgtcgaacaacccgcaagccaaggccgtcgagcggaaaatccaaaaccagctcttcttcatagcaacccagaacgcgcaggcgtggcaacgccagatggcgccgccgtggtttcagggcatgcctggcggctacgaacagaatgcagaagtcgtgcgcgtcggaaatgacggcataatgcggcgttatcgttccatggtgaatgccaatgcgagcgaccctctcagcagcacgacttgggaagaacaacccgcatggtcggcgatgcgatccaacatcccgatgccggccggaggcccaggcctatcttctggcggagaagtcatcacgaccggccgcaacttcaacgacctgttaaatgggacgtgggagttcttctctgattcagtggttatcgcttctcagaatgcccccgtatatccggcttccgctggtgccgctgctggcatgttggaggcgaaatcttgggtgtccggagccaatacgttctgcgtccaacgctacactgatcgcgtcgggaacgtcgctgtgcgcgggcttaatgccggagcgtggaccaactggatgtatgcggtaaacgtcatggctcttcaacaaggtcgggtcacctatggagtcgcggccggatcggcgaacgcttacacgttgacgctagttccgcagctccaaggcggcctggtggatggcatgattcttcgggtcaagttcaacactatgaacaccggcgcctccaccatcaacgtctccggactcggcgccaaagccatcgtcggcgcggccaacttccctctcaccggcggcgaactcggccaaggactcattgctgagcttgtattcgacgcagcaggcgaccgctggagaatcctcgcaggcgcgccacgcatccaagttggcaacgccgatcaagattaccaggcccccagctggaaacaggtgaaggattacgtcgcgtcccaaaagctgactgaagtggactgggctgacgtcgtcaacaagccgaacgtcgccatccaagacaccacaccgtggttcgccaatctggagttgtctgacgctcgtcctttcatcgatttccacttcaacaacaaccgcgccaaagacttcgactatcgctttatctctgaagctgatgggtcgatggcgttctattctcgccaggggtccgctggtcctacccaggatatcctgttcagcaggtcgaatgttacattcctccagccgcgactggatgttgcgaaaaacctcgcgtacatcgcgaactctggccccctttggcagaacacaactgccgatcagcccggttggaaattcaccttcgcacaaggtgtggacgccaacaacaacgcggttatcgcagtcaataccaccaacccggacggctcttatcgctcgcaggtcatgcgatgggactgggcgtccacgaacgtcatattcaacaatcgccctctgtttgctggacaatatgttccgtgggactccggaaacttcgatccggccaccaagctcactgtcgggaccaccaacaacatttcggggccgaccggaattcgcaataccactagcaataccggaaatatgaacacctggggctccggctccacaactgcatcgtatggaaacgcagctcttcaaatcttcggtagagggggtggcgagcctgcggccatctatttcgacaactcccaaaccggctggtatttgggaatggacaaggacggccaattgaagcgagcaggctggtcgctcggcaataactcctatgtggtcactgacgagtcgaatattcggaatcacgtcaatggaatgtctggcgctcctgtttggggaggtcaatggttctggggtaaatggaacttcaacccgaacacaaagctaaccatcaaagccggcacgcaggagactagcagcactgcgatattcagcggaaccctgccgtttgcaccaatcgcgtctctgtccgactattcccaggcgccattgacggtttacaactcgccaaccggtccgtctgcaaaaccggccgtcatcgcgttcattcgtcctggcaactggggcgcgttcttcggcatcgataccgacaacaagctgaaatggggcggcggatcgctcggcaacagttccagggaaatcgccgattccagcaacatcatgaatctttgggcggccaacccgaccgcgccgtcctggaacggccaaaccgtttggcgatccggaaactttgatccggcgacgaaagtggatttgaacgccgcgaacgccaccaacggcaacatgatattcaaccgcatttctggaactggtagcggcatagcttcgtcaggtcgagttggcgccatcaacctgcagaatggggcgcattcggggcaagcggcagcagtcactttcgagcggggcggcagtatcttcgtcaacttcggcttggataccgacaacgttctcaaagtaggtggcggaaacctgggggcaaatgcctatccggtcatccacgccgggaactacaataactacatcaaccaggcgctggttcaggtgggtcttggcggagtcggttcctatggcatctttgcggttctggacaatgccgctccaaccgcgaccgttcaaccgggagtggttgtggacggttccattctcatctactcgtcttgcgccgcaaactacaatagcggtcaaaggcctgccggaacttggcgctgcatgggatatgtagtcaaccgggatgccaacactcctgactccgcgacccttttccagcgagtgacgtaaaatgaaatggacgcggatcagaaaccctcgttggctggatgaaacaaacatccacgccatggtgactttcgatgggatcggggaagttcctttcaccgccaatccgcacgacgtggaggcccacggaagggccatccacgctgcgatcctatccggggcgcacggacctatcgccccggtcgatgcgaagcgggagcaggccttgcaggacgctatacgggccagggaaaagcgggctatccttcgtgatacccgctggcccatagatcgtcacgacgagcagaggcggctgggtatcgaaaccacggacggacctgggttgatagcagcccttgttcactggaggcagcagattcgcgattggaatagcggggatcggccgcgacttcccatggctctgaaaacaatgttcaaaaatcaggagtattgatgaaaatcacgaaggatgttctgatcaccggaaccgggtgcaccacggatcgggcgatcaagtggctggatgatgtacaggcggccatggacaagttccacatcgagtcaccgcgagccatcgcggcctacctcgccaacatcggcgtcgagtccggcggactggtaagtctggtggagaatctcaactacagcgcccaagggttggccaacacctggccgcgccggtacgcagtagacccgcgagtccgcccgtatgtcccgaatgctctggcgaatcgtctggcccgaaacccggttgccatcgccaacaacgtgtacgcggatcgcatgggcaatggatgcgagcaggatggcgatggttggaagtatcgcgggcgcggcttaatccagctgaccgggaagtcgaactattctctgttcgccgaagactccggcatggacgttctggagaagccggagcttctggaaactccggccggcgcgtcgatgtcttcggcctggttcttctggcgcaatcgctgcatccccatggcggaatccaacaacttctccatggtcgtgaaaaccatcaacggcgccgcgccgaacgatgcgaaccatggccagctccggatcaaccgttatatgaagaccatcgccgcgatcaatcaaggctcctgatattcgccccaaaagaaaaggccgcttattcagcggcctttttgctttccggctttgcctcttcaaccatcttgacttcaaccggcgcggcggactcttcctgagtgaccgaatccacatagttccctagtgaactaagaacgccgattaacagcgctcttaccaccttgtccttgactgtctcgcctatgatcttggtcagaacggatattaactcttcccggagtctggggctgattcttggccgaaagcgcttgcgatgctctttgcgtttcatgtttagtcctctgtctgcggtcttctcctcaccccgataatggcttggggatgcgctgtgttaatcggaaggttcgggcgctattataactcgtcgaaaatgctcgcgcttaactgtttaacgatacgcaccgcgatattaaatcgccttctttctgggattcttggccgaaagcgcttgcgatgctctttgcgtttcatgtttagtcctctgtctgcggtcttctcctcaccccgataatggcttggggatgcgctgtgttaatcggaaggttcgggcgctattataactcgtcgaaaatgctcgcgcttaactgtttaacgatacgcaccgcgatattaaatcgccttctttctggccaaggaactctggcggccgggtccggtctaaggcctaatttgtcgacattaaaacgagaaaacccggatcgcctgtagggcaatgcgtccgggtttatttctatctagtgtacgctaggatcagtgacttccgccccacccgtccagccagcaatcgaagacggcgtgcctcggcttgtccttggcgccatgggagaagtgcttgaaccggatgacctggcccttgagatactccctgtcattccagcggcgctgtttctcgtcgtgggtcaggctggaggccgacacgttgaaagtgactccaggccacagacgttcgttgcggcagactaacgcaccgaccattccggacggcgacaggttttctgcgtggctggagcgggccgtgtggccaagttcattgatgaaagcttcattgttgttgtgcatcaactcttccacgtcgatgatctcagcttcatcgtagtcgtatcgcttgactttcacacagtgcccttccttggcagtcgagcgaccgaacttgtacagcccatcagcgcgcttgcccatggaaccttcgaatcccagcattgtgtggcggcgctcgacttcgctgaactgttcgatggaagtcaccagttcctgctcgaccaggtgaatcctctcatagccgaggcagtgacgaaggaagttcacgcgctcggccgccctggctaggcgatcttcggtcggtgcgcgaggatcggtgaaatcatcgaacacatggaaagaccagtccggctcaccgctgtggcggcgaagatcgccggacgacttctggaaaactttcgggtcgctgatgtcgccgcagaccagctcgccgtccaggccgttgaacagtttatcgctgaggtattcgtagatcgattgattgttctgccgcttgagttgacgagtcagcgcctcaccttcgaatacgaagcagcgaaatccatcgatcttcggcgagaaatacatcggcagttggccttccagcagcttcgggtcaaaattcgatgcgagcatgggtttcatacagttctccagaaaagaagcccggcgaaccgggctaaatggcggtaagccggctcagatggtttcgttggcgtggttcagttcggccatgatcgacgcatagcgctcgtccgactccttgatgaacacgccgtcgtacatgacgcctttgcgatccttgatggtgtcgtaggccgcagcgtagcaggcgagcatggtagtgtcgtgctcttccgtcacatcgaacagagtcatgacggccaagaccaggctcttgatggctaatccatgatttccgcgtgccagcgcgccggccagatgtccgaggtgctgcaaatcgtcgccgtaggtgggatgaacttcgacagtctcgctgaagaccgatagatgatcgaacagattttcaccgagttgcgcggccatgatcgtggcaaccaccattacgtcgccgatgccgtctttcacctcgactggtttgttataaacccaggcttcgcaaacttctgcgaactcttcgaccaacttcaggaattgatccttggccgaagagcctttgatcaggttccggtcggaaccccatttaacaaccaggtcgtgaagttcgcgactcatgatttgttcgatattcattctttcgattccttttggatttgggatttgactgcgttgattatggacgccgtgctctggcgcgatccatccttggtggtgccgaagtagaaggccatgaccgacttcagctcggcgaaccaatagccgatgatggtgccgatggcgaccgaggatgtcgggtccatcagagcctcgcggccgaatgtgaagattgcgatgatgatgagaatggagcctgtcagaagagcgaatgtaatcgccgggcgaacgaaatcgttctgctgcgccgcaagcctcctcgcagaatccctgtcggccgcctctgcggcgaactggctaagctcggcctggagctggttctgctcagactgaaggcgattttgttcggcttgaatcgcaagctcctggagacgaacgcgctcggcgctctggagttcggcgagacgcgctagagcttccggattcgcgtctagagcgctagcgaccgaggctgggtcggccttcgaccccagcgccgtcgcgacgatagcgcccacggcggcgcctgcaggcccacccaggagcgaccccagagccggggcagccgcgccgatcttactacctatgtctttccagtccatttcgactcctcaaaagaaaggcgccattacagcgcctttctccggccggtgattcagaactcttcggcttcggtcgcatcgccgacgccaccggcgtcactgcgaggctgttcctgcttgctgtagtccaccttcacctcgccgccgacgaacgacttgtacaggtcggccgcagccttgaagtgatccgggttcttcaccaggccttccagctcgaactggacgccggaccagctacccttgtcgttcgacatgcctacggtggtcatgcggaccaggttggcgaaagtcggcggggtgcgcaggccctgcggggtctgaacctttttctgggacagcgcggtcatgagcttcttcgaggccttgatctgcgaagacgacagggagatcagagcctggccgaaatcgccggtgtccggatcgatgacgatgacgtaatgaccacgggtgtcggcgaagtagtcagacttcttgtcgctgaccgaaccgtcttcgttcggcgcgtacaggcgtccttcgacttccttcaccttggtcgggtctttcatcatttccttgaagtcttcgacgctgatggcgcccttgaaaccgccctcggcctcgcgaccggcccagcggatgaactcgcggcggtacgcggccggaatgatcagcaggccggtcttgccgtcgtaaatcttgccggtgacggtgttcaggaacatgccggccttcgcgccttcgatgtacttcgggtcatcttcatcgacctggggagacatcttctgcagaacctggatgaaggggatggcataggactcggcatcggcgccttcgaagcctgcgccgtcatacgatcccaaatccatgaagtcgggaacttcggtagttgcgacggcgccgccaccggtggcaactgctacggccttggtttcttcggttgcttcggaagtttcggttttcttaccagccatgttaggctccttgtttgtcgaatttcagttatcgctaactgtgggtttataataacggaagttgcaactaagtaaagcaaattacatattaagatttgctctttttcaccttcggtttcgtgatcttggcctctttgtattcgtgcacgccgatgaaatctggcagctcttcgcccttctccagatactcgcggccgaacgcctggagggtctggtaatggacatcgcggttgatggtggcgtcatagccggcttcgatgatggcctcggccgccttcttcgcatcttccatttcgccgcgaccgaactcggccagaaccttggtcttgatgatgccgtcgttgtctgtgtcttccagccacttccagaacttcgatttgttctcttccttgacggaaatgatggccttcggctcgactttgaccgtgcgaccgtccgccagagtagtggtcttttgaccaagctcctccaacagctccggaatggtgttgcgcttgagggttttcagctcctcttccttttcggccagcgccttttgaagatcgaggatttcgacgtccagctgcgaagccttgtccaccaggttcagcagtcgatggccgatgtcggtggcttcgaccgccatttcatccatgacgccaaaatagtcgatttcgcccggtgcgttctctttcaggtattccgggatttcaagctcttgctctttcatgtccgcctccaacttagtgatgttcccttacttgaactaagtattgagtagatattatgccgcatcttccttgatacggctactgatttacatattaaatttcgtcgcgagtgctaacgtcagcctcaaacactccatcaacgacataacttgccaggttgcgcttccactccaagctgacctggattttctcgtcgatggaatccagacagatcaggtcgaagtacaaaaccgagttgacggtgccgattcggtgatttcggtcttcggactgcatccgcaactcgttgtcttcgtcggtcgtgtagtagatggccacgtctgcggcggtgagcgtgatcccgatccctgctgcggccgggttgcccaggaacacctggacgcgcttggtctggaaatcgtcgatcaatttttcccgctcggcctctttggtctcgccgtagtatgtgccaaacgaaattccttgggcctccagatacgccttgatctggtcgatttcctgaatgcgcatggcccagatgatgatggagcgctccgggtcttcctccagcagaccctccagaagatcagtaaacacggcgaatcgcgggttgtcttcgggcggcaggatcaccggctcgccatagacgttgatatagccggatgcaacttgcttgagcttcgaacgcgctgccgcagcatcgaaagatacgtccagcatgaaatcttcgttctggagaacgaagtggtagtcttcctcaacgcgctggtaaacctttcgttgctccggcgacatttcgaagtatatgcgcttgtacaccttgtccggcaggaatgggagcgcttccttcttcgtgacccggaaactgtgcggctcgatcagggaccgaagcttgtccaggttccggaataccgggcgcccacactcgtctttttcgaccagttgcggcggcatggtctgcttcccttccagcttgcgcatgatagctatcattcgaggatcgtcactgggcaccaagacggaaaattcggccacaaacgcccgataggatttcgtccccagaattccattgcgcaagaattggaattgcatgaacaaatcggtcggtgcccgcgtcagaggagttccggaaaggatgcgacgggccacggccttctcgcccagctttacgatctttttcgcacgcttggcttgtgggtttttgatcctcgttgactcgtccacaattgcgcaaactttgaatgtatcaaggaatcgctcgacctcatcatagccagcctggtggttgattgcgtcaacgtttatggcgaagacgcgaagaactttttcatctgcgaacgtctcggcatacagacgatccaagcgcgctctggcctttttggaagtcggtcggccgcgccaatccacgctcaaagtcttgatcgcgacgtgggtgggaatctcgcgcagaatccagttggtgtggacgcctttgggggcgacgatgagcagcgcgtccacgcgcccctgtaggaagaggcgaacggcatcggccaaagtcgtccaagtcttcccggtgccctgctccatcaggtatgcgaaattccgtttgttcagggacgcggccagggcattgaactggtgctgcatggcctcggtcttcatgcccttgacgggatatgttttggctttcatttgttctccaaatcggcgaggaactgaacaatgttatccagtccttctgcatagctcgcaacttccaccaagtcgcggctgttaagctcgaacaaatcgagcatgggattcagcagcagccaatcggtcccgatcttggccaggacgaagccacggccgccccagccgatccgttcccgaaggaaagggatttgcccaggctcgaaacatctggccattgggcaggtggaggcgcgtttcggccactcctccaacgccttgaactcgacccagaactggacacctcgacgattcaggcaaatcgaatcggacataccagaccgccgcgtctccagaaagtcgatcaggattcggccgagtgagcgttgcttaaacgcattcgccgctttcgtttcgcgatcattcatcgccttcgccctctttggaaactttctctgcttgcgctgccagctttgctttttcgcgttcggtcaaaatcctcttgacggccttcacgatgaacatatcgattccgctgagcttccagcctttgatgaggaaccaagagcctgtcggcgttccttcagcaatctgctttccgtattgcagatatttttcaggcctaattctgaaacgtatcggctgatcaaccgagtcgtcaacacacatgatgtcgagaaactgcgactggcccttgtacaccgggtttttcccttgatctgccctcttcttctggcgaatcggttcgttctcatcagacagaacttttttcaccatcttgacaatgaccaggccatcgtctccatcgcggatatcccgaatgttctggatggggtttccggaagttactccaaccagctccggattgtcataagcatgaccccagagcgtgtgagcttcgttcaaatctgcgaattgaacttcagaattcgacagactcgcggcgactttctcccaatcatgaagcgtcttcaggtgggttccggccagctctttatattgagctttcagctccctaagatcggcctttaactccttcagatcggccttcaacagtttttccagttctttgtcttggctgattttcgccgaaagaatctgggcttccagcgctgctacatcagcagccttgtcctcaacatcctgtgccgatatcgggcaattggccagggcgatcctcgcggccttgacgtcatcacgaaggcgcaggaacttctctgccttcgccgggccgaagcctttggcgttcatgatgccgccgatcaggcgtccgtccgccactacccagttaagttcggaatgctccgggtccagggccgtatattctacgccttccttggccaattcgcgaaggatggatacagtttgctggtcgtctttcgccgcccgaagacacgcggccgcgtattccaggcgatgataccgcttcatgtagcaggtccagtacgtcaccacagcgtagctgaccgagtgggagcggttgaatccccaggctccgaaagtcaccatttcctgccacacacggtgagcatcgtccggggcgacgcctatggtcttggcgccctcgatgaacaattcccggcgcttgttgaagaactcttcgccctttcgcgcagacatggccttccggattgccgatgtctgctcccagtcgaactggccgatgtccttgacgatggacatgatctgttcctgatataggaaaacgccgtacgttcctgacagatattgctcgacctgcggaatggtataggtcacaggctcgcgaccggccacgcgctcgatatatttggtggccataccagaagacaacggacccggacgggcgagcgccgtgatgtggtcgatgttttcgaacgcggtgatattgatcgcgtttgcgaccgaacgaactgcctgcccttcgaactggaagatgccggacattttgtcttcgttgagaacatccaggaccgccttgtcgttcaaaggcaagtcgtacaactcctgcgcagtcacacagttcgcgtcctggatgacgcccagagttcgaaggccgagagcatcgatcttgaggaggttcaaatattccgaatccggcttatcgagctgcgcgacgccttcagaagttaccgtacagaagtcgataacttcatcgttgcagaccaggatgcctgccgcgtggacgccagagtgggatgggtgaatttcgaggtcgcccatgcaggcggacgcgatatcatacttttcgcggaagtcgcggccgggttgagttttttcgaaagtgtcctccaatccttttccatatcgttcgtccgccgacgtatattcaatgatcgagtttttgatgttgtcggtatcgtggaaggggatgccgaagcgctttccgacgtgagcgataaccgacgcggccttgagtgtgttgatattgcccaacttcaccacgttccaagtgccatacttctgctggagatattcgaacactagatagcgatgggtatcggcgaagtcgatatctatatcgggaagatcggaccgggaaatgtcgataaagcgctggaagaggaggcgatgcgggagcggatcaacctctgtaatgccaaggagatagcagaccaaagagccggccgaagagccgcgagctggaccgaccagcatgtgcttcttggcaaacgcgaccagatctgccacgaccaggaagtagctgtcgaaatctttcagttgaatctgcttgatctcttcttggaatcgatcctcatactcctgggtccactccttgatgtggccgcgactgaggcggtaggcttgcccctcgcgagccagagcgacgatatcaccatccaagtggatcatcggcgccttcgccagtttcacatccgccaactgctcgactaccgcacgagtattggcgatggcggaatcgaactcttcgcgagtcatgatgtggcgtaaacggctccacagctcctcttcagtggcgatgtggcgaaggccgaccgactcccgcaccttccaggccgacgcgaaatcagcatggtcgatggacggcatgtcgttgtaagaggtaatcaccaccggctttccgaatgccctggccgtctccatagcgccgtgcgcggcgaccatcgacgcgggattgatgtcaatgtagtcgattccggccagatccagatgggcataggcctcgccagcgaatttgatgacgccgtcagcttcctggaattcttgcggagtcaatccttgattctggaccgacttggaagtcaagcggtagaacttcttggtgtccttggcgagcacccaggctttgagcttcagctctttctcgccatcgtcggcgcatttgatcgggatttccatgccgaatccgcgaggcagttctgccttggtagcggcttgttcccaacggacgtggccccatgttccatcatcgacgatggcgacgaatggggattcgatctctttggcgcgctcgatgatctccgggaatcgaccatatgcggcgccgtaggagtaaccagagcgaacgcggagctgagggaaagacatcatgcggcctccattgcttgatacgcccgatacactcccatgcgcttgcagacttcgtggagcagccgcacgtcgtcgagcgcccggtgtttctgtacatatgggccgcagtagtgctcataaagatgttgcagccgcatgcggtggccgaacaacggcgccgactcttccacagtacagatatcgagcgatgggaaattgacttcgtccaggccgaacttgccgcgagccagatcgcaggtcagcatgaacttatcgaatggcaggttgtgggcaatattcgcgtcggctctggaaaagaagtcgcgaactttctggcgctgatcgaggaaagatgggtgcttgaccaggtcttcgttcttcaacccggtgatcttggtgatgatttcctcgataacgattccaggattgcagatgaactctacttcatccaaaatcttttcgccatcagttatcacgccggcgaattcgatgattctcggctgctttctcagactcaccctttggtggaacgggagtcctgtggtctcagtatcccatacagcgaatatcatgtttgttccctcttatgtcgaaaggccggctgctttcgcgaccggcctgaggagtatatcgcgacggctgaaggtttacgccttctgtccgtctttcggcgtgatgcggccggagcgcatggtggcgtgaacaaacgccgaatagttgatcgagtccaaggccgaatcggcatccttgaacccgctgttcgccaggcgagtgagtttacccaccatgtgcatcacgaacagggcgagtcgatgatcatcggcggtcttcgccaccaggccgttcgggaagaggatttccatgatctttccgtacatcagatcattgcgaccataggtgctctggcgggcgcggaagacttctgctgcggcgtacagattgttgagaacatcttccgcgaaatcatctggatgggaatcatcttcgcccggccagacggattccatggcgaacggcgcggcgtcttcggtcgggtcttcggactgagccgtttcagcgagcggagacggggctttcgcaaacgcctcgtcgagggtaggggcggagttcggggcggccgggaacggctcgcctgccatgtcgttgggcgcgctatcggggtcgctatcggccgcgacggcgaagaacggcgcatcgcagccttccaggttcaggatgtaggaatcgacccccaggctgttgtaggcatcgatgatgtcctggcgatcatcgaatgccgcgacgatcttggtgacgccttcgattttcttcaggatatcgagcacaactgcccgcttgaactgaggcgccggctcggtgttaccatacggccgcatgatgagttcgtactcgcgatgttcggcgatgccgagttcgcggtggatcttggccctggtctggaaaaagtggttgtcggttcggccggtgacgaagaaaatcatgaggtcggcgtcgatggcattcctgatgcgacctacagcgtgcgggttgagagtgtccttgtcgagacgagaatgatactcgtcccattgccgttccaaggcgaagctcttgcggtggctatcgtcgaatacgcagccgtccaggtcgaagatgatgatgccattctttggtttgcgttccatattcagatttccttggtggttgctttctgagtgacggttttctcgatgaacgtcccatcagaagtgaggcggaaaacttcgccgttctggatgaaatcgaacgattgtacgttcatcgtgatgcgaatggattcgctgccgttggtaacttcgacttgtgcgatgtcgccaactttctcgacaatgatcttcatgttacatggacttcccgttgacggccacagggttggcctcctgtttttccgatccccagaaatcgcggcgcagctcttcctgctcggccgagcgatccatccaggggcgatagaacttgcactggtagataggttccaacggaacatcaaccacaggaatctggccgggcttcgtctccagagcggacatgaaccggtcataggatttctgctggatttcctcttcattcatcaccttcgacccatagcgcgggaaggcgcaggagccggtggcgacgcagtgcggctggagcaggctgtcgaacataggatagatttccagaaccagccggcgcatttcgcggaatacttcctgatattcaccctgggtccgaacgcacaggcgaaccttcgccatgtcgctgagagtccgcagattgaacttggccgcgatcttcgtttccatgttggaaggaatgattgcgcgagcgtcctggagcgacgcgccggcctccagaagcttctggtagctggtttgcgcgtcggcaatggcgtcatgccacagacggttcagctcttcgcggacatggtaggtcgggtcaggctcgccattcaccgtagccggttcgtcgaattcccagcggaaagcttctggttgaacgacggcgctgatttccagagcgcgactggtttcctgctggtaagccccggtgcgagtccgaacgagttgatgggtgaaattcttgctgacgccctcgatctggaaaatgaagtccacgaactcgaacggcgagcggatggtgtccagcatgtacttccagtggtcaagcttttcggcctcggtcatggtcgccgggtcttggccgcgcatgcgggtggacttcgttcccaagagcaattcccaggcgttctgggtgtaactgatcagagaaatcttcatcagaaatcttccggaattggcgtgaagtggaatttttcggtgagagccagggccaggccttgggcttgctctttacgaaggccatactgctctatctcttccttgagcagttcgcaggcctccagacgcgactcatactcttcagcctcctgaacggatgagaagacggttccatcagaggttcggtacacaagttcaatcgacatggtgacctcagtagcagcggatgatttcggcgcggatatcgcgacggtccaggtagtgctcacgaatcttgtcgcgggcacgctcagcctcttcgcggctgccgaacgacaggttgaacgacgtgaaaggcttatcgtccagttcagcgccggtctgatacaggatgcctaccagaacgaaagacggcgcggtcttcggctgctggtcggcttgcatttcgaggaaggacataggaacctcttcaggatgatctggtgcgtaaattaatagcgctcctgctgagcagctacggtttccggctcgtagatgagcatgtcaacgatttccgggcactggcctttcacccagtcgatggccgcgaccagtgtggtggaagcggagaaagagaaagtgcggtaagactcatggatgtacggcgaccccatggaatcgcgctcggtcgtgcgcgaaatgactgctttgatattaacgatccggcccatcttcggcctccactttagcgattatatcggacaggcttaacttctcgccattcaggaaataactggcgcgaaacttcctgtcgccctcttgcccgacgattcgggccgttatggtgagactcccgccgccaagggcatcggtgtcccggaagaaagtcagcagcgcccgcttgagcgctgcttcgcgaggatcgacggccattaacctaccacgttccagccgtgctgagcgcaccacacggcaccggtccctgcaggaagactattcagaaggaacacaggagtcaggcggccatcctcggtcatatggacgaagtagcgggcgccttcaccgagccattcggccttggcgatggcgcgttcgagattggccttggtggcgtaggtcttggtgtggttcttgtcggtggagaaggttacttcgcgggccatttgtcgattccttttggttgaagggtttcgcgtttcgatgagggaatattacgcccacctgatccagaagtaaagcacttttgtaaattacttcacgaacattttcttggccttctgataagacgaagaagtcatcaggcgctcgatgacgtccatgtcagaaaccagatcgtccagaaggacgttgcgccaggtagcgaaccggccgagcgagaagatgccggcttcatgggtgagattccagatcatggattcgcgctcgtcgcggccgagcggaacgattttgcctttggtctggatggtcggctcgccgtcctcgatgagatgccttttccttatgccgaaggccgcgcaaacgtaatccatatcccagtcgctgtcccattcgatggtttcgattttaccatctaaagtctccactatccccttagtgatggattcgacgatcagagtatcaccggtgatggacgctcgaaacgttcccactttaggaccagggaaatacacggtctggaagacatcacaggggatggaaagcttgtatcgactcacgatgatggaggttccttcaccgaatgacgggtcgattcccaggtccagccctgccgcagccagattggcgcggaacggcgcggtgctgatgatattcacgtggtcatcttgccggcgaagatactggaagaaagaggcgtcgaaaggacggctccaagtgatacgattcgcaagcttagccaccagctgctcatagtagtcggccggtgcgatccaacgcttttcagtcgccagattccagatggaccggtccgacaggccgcccgttactttcctggagtacatgttgcagtggtcgatgcgcggctgggaaatgaactcgccgtcgatgtagatagctttgtgtacagtgacttcgcggaacgggatgccggtgagttggccaatcactggcgagcggaatcgcagaagtgcgttgtggcgctccttattctccggcgtcgccgcgtcgatgatttgggcttgaggaaagcgatgcgcggcgatcagtccggcgagtccggcacctacgatgattactttctgatcaggaatcatgatgtgtcccttatgagtgtacaaaacttgagaggataaaaaagggacccattttcatgagtcccttgaagagctagacgattcaggctcagaggagcggcggcttactcctcctcaccttcggaaccatcggcgccctgatcttcaccgtcgtgctcctggccttcgtcatcggccttctcgtcatcgccctggccagcttcgtcttccttcgaagcgatggcaaccagatcgacccagcccatgatttccagcttgctcaggtagctgcggaccgaagtgccatagagcagatgggccaccttttcgccgaaggattcgatttcgaccggctcaccaacggtgcagtgctcgttgatgtatgcgaacaccttgccgcgagtcgagaaggcctgcggagtgccatggccgtcgccggtcgggatgaagtgagtggcgcgggggcgacgcgagccgttggacttcaggtcttcgcggcgggcttcggccttcttgcggcgctcttcctgctcttccttgcggcgctgcttctcggcttcgcgctcagccttcttctgctcggccaggcgcttgcgctcttcttcgcgagcgactttctgagcttcctgggcggccttcttctcttcggcctttttggctcgctcggcttccttctcggccttcttctgctcgcgctcggcttccttggccttcgccttctcggcctgctcggcttccttcgccttggccttttcagcacgctcggcttccttggcggcggccttttccttcgccttctcggcgcgctcggcttctttcttctcgcgctcggctttgcgcttctcttcgcgctcggctttcttctgctcggcttccttggccttggcttcggccttctcggcgcgctcgcgctctttacgttggcgctcagcggccttctcggccttgcgcagggcagcggcttgttccttggtcagctcttcgccttgggtctgttcgttctggtccttctgttccatgttcttactccgggaatgtttaaagggatggcttattggcctgtgaggggattatctctaaactaattgaagaagggaataccttagcctgaactttcctaaatattttctttcgggaaagtccagactccagggaacttatttatgttcgcgaagtttaactcttgcgcaaaaacaacaagtattcaactgcacgagttatgccagtatacatcaactgactataaggaattgacggtaagttttcttccagcattgcgactcgcttccattccgatccctgcgacttgtggaaagtcatcgcccaaccaaagtcgaatccgccaatggccttctgcgcctccagccgtacatcttcctcggccgaaaagctcaaaggattgaacttcacccagcgctcatagttcgtgccgataatgcgaactttggcaaacagcatttcatccggctcgtcatcatcctcttggccttcggggaccggcttgagttcgagcaggatggcttgctcgccgttcataatgccgtattcatgctggttcccagtacacaccagcttctcgccgatttccggttgtaaacccttgtagccgaggatgcggcgcgccctggcgttcaagcggcggcgagtattgttgtaggcgcaaaggatcacgccatcgtcatccaggaacgtccgcatttcgtcgtccgacatatcgaagccagcccggactaggatatcatcatactcgcggcagggcaggcgtttgccctggcggacgaacatcgacgctcgaacgatattcccggcgttacgctcgatttcagtcatgactgtgtcgcagctatgttcgtggaaaacctgaacgccgcgcacagggggaacttggccaaagtcgccgatctccagaaccggaattcgatgcgccaacaagcgctcttcatcccactcaccggtcattgacgcctcgtcgagcacgaccaacttcggcttctcgtcgagcgagtctttattggcgaacatgatttcgccgtcttcatcctcgccaatcggccgatagatgaagctgtggagggtccgggcattgatacatcccttctcgcgaagccttgcggccgctttcccggtaggcgcgacgaagaccgtccagtccatcgagcagcaaagttcggcgatgatcttcgcgatggaagtcttaccagttccggcgaaaccagcgagtcgatagacctggcggcggtgcgctcggtcacaccaaccgcgataccagtccacaacggaattgatcgcgtcgatctgctggctgtttggccgaaaaccgaatcgctcttcgatctgatcgacggtgaagttagatgctgacatatttgcgttctccaacgctaggtttaattgaatcgagactcagtttaagcacgccgtccacagaccatccagtatcacgacgatacttgcggccttgcggatcgacatagaagttcttcgtgcgtcgcagcagaacataatgccaagcagctccaagcgcgtggacccttcctttatacgggaaagccttcgcctgctctgcggcctctttggccccagggagccagcggacggtcgaaaggaccagtaccgcacccttaatagcctgggaagcggcgcggccgtcctgtgggctatagcgatgtctatcgaagtctacccagtggcggttgccgcgccggagcttgaccgttcgggatcgcccctcgaacaccaccgtgccttcgtgagtaaaaatatgttccgccatcgaatgtcctttataacgtacagttatgctttacctctgcgcaggaagagtatactatcagctgactcgccaaagcgagcgaatttaatccaactttacttcggcaggaaagtggccgatactagcgccgccgcctgtactgccctccaaaacagaggatacattaaatgcaagaatgcaagatttcccgcgaccaactcccggtcggtaatccgaatcccaatgtcgacaagacccgcgacccgaaccttaagcccggtttcctgcgccgcagccgcgagctggacccggcgctggccgttcgcattcgtcgcgagctgatccacgccgaagcatccgacttggcgctggccggatgggtcaattcacagtccagcctttatggatcgaaagccttcccgcgccattccgtcgttcgcgtgaccggagttccggaagatggagctttcatcggcatgctgatcggcttcatcgagcatcgcgagcatggcgaatgggcggtcatggaagccggaacgaaagaaggcggcgccgtcattattccagtcgatcacatcatgcgagcgtcattcgccgaagccgaagagttcgccgaaaagtgggagcggaacttggggtggcgtctcctgcgccagctccgcgagtgcggcgccctggccgggactgaagacgagttcctgcggcggatcatcaatcgatacgttcgtgatcgcacgatcctcgatcaccacaaagtcggcgcggacaaaatctatactgatgcagtactcaaaagcatcggcgaaacatggccgaagattccttcgggaaaattcgtcgggcaccgagtcgcgcaacttctgatcgatcacaaactgggtcgagctgggaccattctgaatgacctggtggacttcctggagaagttcgcgaccggacgtgataaagtcatcaacatcgccatttgcaattgaggtgaatggaatgtataataaaccgacgctaaatcaccaccatcaaactgcgctgttatatctgtacaacaatcccaatcagccggcattcacagggcccaacaatcaggcgctgaatgaacttcggcagatgggatatgtaaaggcgaaaaagtttgaaaactgggcaggcacgggaagttgtaagtttgaatggtatctcaccaaagcagggatagagcgcgtggaagttgggatactgggaaaatgcaccacttgcaatggtagcggccagactttgcttcggggaaaatgcaccacttgcaatggtagcggccaggtgtggatcaacgaatggatgcagaagcccatcgaggataatcctcagatcatccccaagttcgaaaagaccgatgcgaatcggctggcagacgccattgaagaaatcgccaggctagagaaggcgctggaagaatccgaaaagcgcggcgcagaactggccgcgagctattgtgacggtgtagtcggcgatgaacacggccacgcttattgccgttataaagtggaacgcgacgccgcgctggccgaagtcaatcgcctgcgagaatccaagggcgatccctctggcagcttcgacaggtgtgtgaagatgatgtacgagcgcgacgagaatgcgaaacgcctcgacgccgcgctggccaggatcgcggagctggaagggaagttgacggactgggtgcacgaagggttccggctcaacgaggcgctagcggtcgccaaggctcaacccagcgtgccggaggggtggaagctcgtaccgatggacccgacatcgcagatgacctctgtcggtcagtccctgcgttatgacgcggtaaacagcatcggcgagatttaccggcaaatgctcgccgtagcgccctcacccatcgatccggccgcgcatcctcagccgtgccaacaaccacaggcccatcctgcccgctgcgggtgcgagcggtaagtgccaagcaaggagttcatgtaatggaacagcagaaaccttcgaaagtagatggagccatcgccatgaccgatctcgatattcgcatccttcgaaaggcgaagcccgaagcgcaggacgagtgcgccgtgtccatgttcgcaacggcgatccgccagaaactgcagcgctcccgcgataaaggccgaggcggctggatcgactgcgacgaagatgttctgatcaacggattcgccgaacatgcgctgaaaggcaatgagaacaacctcctggacctggcgacgttcctgatgttcatgtgggtgcgcggcatcgatgatgcgaagattcccccggcgctcgaaaaggcgagacagcacaagatcatggaagcctggagtcgaatccatgaagacggcctgaactccgccagaaaggcgagtgctgcgcgacagttcgtggaagtgccacgacgcaaggggcgcccggagcgacttgcatgaagcctcacgaaataagactggcccaggccgaagagttcctgcgcgaactcggccgagggattccggacgacgaacgggtgatggtcggctacgctgaagaggccacagtccagaccgacgaaaacggccgcaagctcaatgccggatggtggcccgtaccatggaaggaagggaagtacatcaattcccgatccaacgcctacgcttgcatctcgtcgtccatcaagacgcccaacccgaagaccggccagatgcggtactggcgcggcgaagcctctttcggccacggcctggcgttgatggtcgatgacatcggctccggcaaagggtccaaaggcgacttcgaccgcgacgaattccgcgagcgactggagccgaccgcgattgtggagacttcgccgaacaactaccagttctggtatttcttcaaagagcctatgtcacacatgctccagttcaaggcgctgctctattcgttcgtggaccaggtgctaaagaagggcggcgacaacaccgtcaaggacgtcagtcgttacggccggatgccattcggcttcaacaacaagcgcgggaaagacggcaagttcaaatatgccgacgaaaacggcaagccagaactcgtgcgcctgtacagcgccgactattccaagcgctactcgccggaagagatcgcccaggcctttggcgtccgcatcatcatgccacagatgaagaaggtggagataaaccgcgacgattgggtgtatgaccaagtatggctgaagtatgccgagcacatctgcacgaaatacaagatgggcgaagcggcaggcggccaggtccagcagaatatgtccggcaaataccgcatccgctgtccatggggcgacgagcacaccaacggcgatcctttcggcgcatactttcgcggaccgatccctggagccgagcacgaatatgtgttcggctgcgggcacgatacttgccgcaaagagcatcgccggacttgggcggccttcacggatgaagtcgtgctaccctatatcgtcgaacaattggaaagaatcaaccgccgtcatatcggtgaggagtagacaatatgcaaaacgatcctggaatcctgattaccgccatcggcttgctgttcctcggccttatcatcttcttcgaaggcctaaagggatggaaaatacaagtcgcaaacttcctcgcgtcgcttctgtgcttcttcttcggcctttctgctttgacgttctggttcgtcgttgcgtttgacgtattttaatcgacgaacggtacagaaattttcggatggggacggaacttattagctatgccggtttaggtaggagataatagccgtccctttcgcctcaatgtgtagaggcaatgttgaatccgatcatgtaaagcagaaggcggcaaacctaacatgattatcgacgaagataatatttttgatgatggcgaatcagggtccagtgagtttgatctcacgcagatagaagatgctggaatggaccctttgatgaccgccgcgagcaaggcggccgatgatgcgattgcgaggaacgaaacgcatcgcgcgcaaaaggcggcaagatacgccgaggcgtatgctgaaccagacttgaggaagcgagcgcggttgttgatgctcgaccaggcgttcgatcttccggtcagccggctagtgaaaggaccgttcgacgacttcatcacaaagtacagctcgacttcagacagcaactacctcgcggtctatgatacgttgttctgtaagggcgacggaaccgtcccacacccgcacttcgacgagtttcgcggccggctggtggaccatcgcggcgtggcgttcaacaacaagaccctcgatccgattgacctgatgggcgccctcgcggctgcggccttggacgatccctcgattaagaagacgattgagacttgctgcgtttgggcgcgtcgatatcgccgcaactcgctgatcgagacgtttgagaagaagataccggattgggacggcgaagagcggatcgaaacgctgctgatcgacttgttcaaaccgttcgacaccgagcttaaccggatggtgagcaagtatttctggctgagcttgtactgccgcatcaactaccctggaatctcggcgccgatctcgttggcgttgattggtggtcaggatgcggggaaatcatatttcggcttgctgatctgtaaggaactgtccggtgggcgcgatctggctccagttcagctcgacctgagccgacacgaccagacgccgttcctgcgcaacatcaccggcaactcggttattgcgaacgtcggcgaaatgtccggcttcaaaaagggcgacatggaacgcatcaaagaattcctggtgcgatcttcggatacattcgatcagaagtttgagcctggcgaaacgatcaagcgacaatggatcaccatcatggacggcaacggatacgatggactccagcgggacgactccggcaaccgtcgattctatccgatgttcgtggcacaacttcccgacgaggatggaaagccgaactgggttaagccgggcgatggtaatgaaccgttcaaggtggacttcaccgacttcggccgcaaattctggcaagcgatggctgaatgccgcgcatggatcgaagagcatggtgtcgatggatacttgaatatggtgtctgaagcgaaccgcgaagtgcagaagttctctatttcggaaatggagaatgcgcgtggcgtggttcgtgatgacacgattgatatgtatctgatcaacgtgctgatcagttgcgagttcgaagagatcaagcctggcgggaactcaaagactcctgggtggcgtgtcaatacggtggaaatcttgaagtggttcgatattctcgccaggaagaagccgatttctcgccatttaactccacacctgaaatcgcttggattcattccgaataagaacggcctgaatggatggctactgcctgccgataaagttgccggtcaggaaataattgggtctttgccgtcattcaacgatgcgctgatatatatggtcaggaagaatgacgccgctgtctctgatgatgatgccatgtcgcatatccgcagggtcaaggcagagcgagccaagatattgggcgaggatttctagtgtactgatgcagttgtggttggactaggccgccttcgggcggtcttttctttggcgcggagaacattaatttcgctcgtgaacaggtgatgttcgaaagctatctgggaattagggtggggtggcggtggtgtattgtgggaaattgatagattttcggtattggtctggcatgtatgatggctggattttgcgtgaaatgttgagaaattgtgggtttgaggtgggttttcgggcgggaatcgccgcaaattcctggattgctattctgactgggaagatgggaggcctactgccgcgtgggttagcggccattttcccgaattcccggttttccgagcatgggttaaaactattctacagcgaaaatcgattgcccaatcctaatagaaaaaatctatcacggacgttacctatctttaaaatcaataaaattaatgggaatttggtaatttgttatggttttaggtttgaaagcctcgcggcactaagccggtacactacccgtcgagtttccgattccgctcaactcgcggcagggtcgccggaaacttccgtccttccaaacaatgggcagcggcaacaccacggcggactaagcggcagcggccaaaactcgacgagcggaaccggaaatttggccacagggcagaatcgctcacctggacatattcctaacattcgatttaacattcaatccaaacgctcacccgccatcaaccgatccgatcctcacccaccagcggatcgcccgtataacatcctataacaccacctaacactcattcatcatcaaacccacccagacctacagcccacccacaagcagcccatagacgcgatccctggccccatagtacaatcgcgccatactcagtgtcgcgacagagcaccaggccccatccaccaaccgagccaccgcgacgactccagaatcgaactcagggacgcagcaccaaatgaccaaattctacagccccgacgatctagtcacgccacaggaattcgcagacccgcatttcgcggcgatcaaccaaaagcgattcgacctgtacatcgacctgcgcgtccaaggttacagctcctggcgggtcttccgggccatctggggcgaggagcatatggacggtcccgcgcaggcccgcatcttcgcgatggagtccaacccgtactatcgcaagcagttcaaggccaagttgaacgcgaccaaaacgtccgatttgtggaatccaaagacggcgctccacgaactcctccaaatggttcgtgaccccaccgtcaaggattccagccgtctgtcggccatcaaggaattgaacgttctggctgaaatcacgttcgtggacgagtctggcaagaccaggatcggtcgcggtttggccgacttctacgcatcagaagcagaggctcagaccgcgaccgtcgctgctgcggccgaagccaatggctatgtgccggaaggcgaagagggagatttcccgtctccgacgccggaaccgaccgaggaagaccgcgccaaccccatttagacataaaataacatcgttctaggcccgaatcggaccgaactaaggcgacggtagcgggaagggacgaaaaacgattctagggcggttctaggaagtcgtagcctaaccctcagaaacgacaaagccccggactctagttcagaatccggggctttcttttgggtgccttattcgccagcttcgatgatttcgaagttgtatttgacgccttcgtgctcgaaagtcatcttgccagccgccttcagctgcatgcggaagcggatgtgtttcgaagaaggcaggccgaactcgatgaatgctgcgttggtggaccggaactcgccgcgtttgcctttgacagtcacagccacgccatggcgctgagtgcgtttcttggaaacttccgggtctttccaggagttggcgatggctgccgacaggtcttttgactctttggctttctccggagcgttcttggcctcttcgcgcatcttccggatttcttccagcgcttcctcttcggtgatctcttcttcaggcttcagattctcttcctcggccttctcttcttccttcttcttggaagtgcgggttttgtaaacctttgccggggcttcctcttcctggaaggcttcttcctcggccggcagagcattcaggatggcgaggcagcgacgctcagcagtcttgcggtcagagaaacgcttgacggtcgcatcggcgttgtgggcgttgtagaaggcgaccagttctttcatttctgcgttctggatgtcgccgaaggttttgatggagttggtcattttgcgatcctctgttttggaagatttcgttcgggcttcggtttgtcgccccgttgaaagagattatgcctaggtcgatgctgcgtgtctacatttatttcagcagaatgatgatgaacccgacgaacggttgtcggatgtgaaacaccgcaggacaggctgcggtgttttctggacgatggtgcgacggtcagaaagtcgggactgtgatcggctcgattggcgggtcgccgggcttgtcgttgtccgatgcgggagctggactggacgggatcgcgccggaccgaagcgacagagattccgactgcctgctcacctgcggagctggaggcgcttttggcgcaggaggcgcgggcggaaccggcaggcctggaggagccatcggcgccctgggcggttccggaagatcgggcagatctggaaggcttggtgctatgtcgccgaaggaccgctgcgactgctgcgccggattgtcgccgaacatttcggcggatcggttgtccttgatgacttgacctatggccgtcttgtcgccgcccggctctgccggatcgaagcccgtgaatggagtggtaacgcagcgcatgttcggatgggtaggcagatttttcagaactatggaatctgcccagacatacggattcttgtggttgccgggtccgtggctgatgatctcggcaggaatatggccgttcatggtaagccattccgccatcccttgccgagtcagcgggcttaccacgatctggccagtagactcttcggcgacggcgaacagatcaccgagcttgaacccgatgattatgtagttggacctggactcgccgacgaaagccagggtttcgatgttgtggtggatatcttgatcttcccagatgtacagcatggtgtcactcctcaataaggttgcttttggtgttcgaccagagacataccggccggaactttgaagcggacgtattcgatcatcatcgccgttcgacgccgattcgtgcccgactcgtcattgacgaatagttcgcactggtgcggaatgactcgcgtcaccaggccttcgcctttcgagccgtagaacttgatgtaggccgcgacgcctcgcgtcatgttcagatggatcgtttcgcagagtcgctgcgcggccgacgcgctagacagatcggtcggactgaccgttacccagtaatggccactttgttctttatcggacataagctgccctccaatgagaaagcctctgccgagtcgcagaggctggttgttgttagtcgcgcttcaacagaacgactttgtcatatgcgcgatatttaccgcgccagtcttcccagtagtcgccggccgggcaggtaagctccagggtgatttcgtcgcgccagcattcgacagaaaggacaatcgccttgttcctggctgctgaatctgctctgagcttaatcagaatttcgtcgccagttttcagctcatcgacccttacaactttggccattgcgttctcctattgggtagcgccacgagggcggatcgggtcgatgtcatgtaagcagatggtgggatagtccctggccagcttgagcttgaagtccacccagtcggcaccgatgagcgccgcgacttcgatgcttactttgcggtgcggcgcagctccggatcgcaggactatagcccgacgccgaactggatcatttacgtcgacatgagttagtatttcgtcgccgacgagcaactcacaagccatcaatattttggccatcatacactcctatgagaaggcgcggccaggacgatcccagccgcgccgatggattaacgtttgtgaaggatggacactgcgtccacgtcgaggatgctgatggtacggcgacggcgcggattgctgcgttcatgaatgcgaatcagatcagcagatgcagcttcgtccaccacccatacatcttccggcttctgcttccggagcaggaccgttacctctgtgttctgggcgaggccgttgcagatgaacgtgaacttggacgagggagttctgtacatgtcgagattcctttttggacttcgggtccggcttttcagtcggtgaagagattatgcctgatcatcaccgtcgagtaaagcacttatggaccaattctccagttaaatggaaccacagcgcggtatcgctgatcgctacgctcccacgccatggcccttcttgcttgcatacttcgaaccacaagctgatttccatccttgccaggactcggccgaaggattcgagccggcgccggctagccaggatgtcgacattcaaccgccgattgatttcgtatcggcgaccgttgatgacgaagactaggcgtagggtctgtccgtccagacattcccagtatttggtttcataccgaagccagtagcgcttgccagccgggcctaccatggtcatctaatcgatgctcctggccgcgccacgcggtccggccggcggcgcaggatcgaaccgccccaggatgtagtcgggccggcgcgcttcctgaggacacacggcgagaaggcgccatcctgcgtccagggcatactggagttcgtccgtgcagcagtcttccttgagcagcagacggttgacgctctggagattcggaccagggatggccgagcttgtgtgcgagttccagccttcgatgccgtgcaccatctgcggttggttgatgtagccttcggacctgccagccaaccggctcgcggccagctccaggcgctccagcatgggtcgcagagcagcttctgggtcaacgtcgtcccagagaaggaccaagctgatgatggtgtatggatagtccttgtccagatcccaggccgaagcggtcagacggcccaggccgatttcattacacatcacgggaacgtcgttgctccatgtggacggctcccagttccgctcaccaggattcccgattgttacgccttccaggttcccaaggagaacgtggagcttgctgacgtattccgcctccagcgctttccgctcttcgtcggtctggttgtggcgatagaaggatggagggctgacttttgcatggtagagtttcatggcggttcctcggtttttgaaggcttgaacgttagagaatggtgtcgcagtatttctcgaaaggactctggcgcttcttctcgcagatcgcgcaggtgatttccaggtcgggcagctcgctgcaagtcttgccgagatacagccagcgcttgcacagactgcggccgtccgccgcgaagaagtggactttgcgagcatttccgggctgcgcccagccgccttgatcgtttttgcgcttgctcatggcgatatctcttttggatctggaatccatgccgtccgttcgctcacccatactccatctacataaatcaggactgacagagcagtcgcaccaaacccgaagcctacatagaatgagccgggatcgatctccatggtggcgctattggtggcgctattgaaatcgacttcaaagtcgaacatcgaatggccaatcataccatcaccatgtcgatttcattgacgaagaaatggacatcgacaccatcggcgcggccggtgtaacgcagccgagtcgtcccatcaatgtgagcttcctcgacgccgatgacttccaagatggtgtcgttgcagtacagcttgacgaacatcttgatgccggagccaatcgccgcgaaggcaatctgcttgtacaggtcttgcttgatcatgctttacgctcctgtttgcggatgtactctgccctggcttcggcttcgagcttcacccaaagcgcgttgtcgactggaccccagggaccggtctgagttccgtccaccggtgcgaacttgccaccggcgcgacgatacttggacagagttctcaggccgatgattttctcttcttgggagtcgagttggacgatcatttgacatacttcccgaagtagcaggtgtggaggatttccatacccttggagatagccttcagcttgataccgaaattcttgatcgcccagtccagatcgtggtgatagaactcgatgatgttgacgatttgaccggcgctgtagtggatgacgcgaatcttaccattccagcggaaatcttcgcggctgtttacggcctcgacttcgatggtgtcgtttctgccgatggtccatttggagctagtcatgtcgcaatcctctttttggagtgtttcgcgtttcgatgaggtaactatacctcagtcacctcatcgagtaaagcactttcgaacagattatctgaaatttctggaagacagatccatcggctgattcagtcagtggaaccgagactccatccgttgcgggcgaaggccgagcgaccagacagcttgcggcactggatggagctgccatcgtcgaaggtgtaggatacggcccagtccaggcgctcgcgacgtactgccgcagcagcgatatcttccagacgggctttgagaagttgttctgctttggtcatttcgagttcctctttggagcgcttcgggtttcgatgagatgactatacctcagtcatctcatcgagtaaagcacttctgaggaattatctgaagtttctggaggccagaaattgccgccagagccagtcaacgtgatcgttgagatagcgctcgccatcggacgacagagccaggcatccatcctttatgccgagtttggagccggaaatccattcgaactcgaactggagcgttcctgggcgagggatatgggacaggttgtacttttgcacggtcagtagtcctcgaaaggattcatgttggctatggccgcgactttctgcatgccgatgcgatagaattcggcctcttccctggccttgaccatctgctccctggcttcgcacgccagcttgtgctgattgttggcgttctggatgcttccgtccagactcctgtccagttcttcccgaagagccttctgcgacgctagctcggcctccaaatcctggattctgatctgaagctggcgattcctttcagaagtctcgttttcgcgggcgatggagttctgaaggcattcgtcaagacgagtattttcgcgcaccagctgatgcttttcgactttcgcctttcggcatgtctctcgcatcgctgaaagctcactggcgtgcaaatcagcgtccgggtctttacgctcttccttcgactccatccgcaggtagtactggccggctgcgaaggcgagcactgcctggtcggcatgctttacggcttcacccatgtagtgggtttcgtagcgaggccgaaacttacactcatctgcgtcccatagcagactatcggcaataggccagaatttgcggaagccatccggatcgacttctacattgaccatttgcagctggccggcctccacttcgacttccagaggaacctgaatggtgccggtgatgtactggaagcacactatgctagacataacacaatcctcataagaagtcgcggccgggaccatcccagccgcatcgtaatcactcttcgccttcgtccgcgctcagccactcttcgaaggcgaaattcactttcgactcgacccaatcctgcagctcatcggcgaactcgtcactgtcgatatccatcggaacgcccagagtttcttcattccacaattcagcattcaactcgaactggaccatttgctcgccatcgacttccatcaggatgcggtctgcgacttcatagtcgtctacatcgaacagatggccgccagtcaggaggtgctggacgaaagcttcatcgagattggtgacttcgatctggacttgtttggtcattttccgtctccttacttagcggctttgaattgggctttgaggttggccagttcagctttcagatcgatcatcgcctgaccgcgcaggccttccatttcggcctcgctgatcgcgatcttggctgcgcggattttgtcgttgatttgatctttagtcattttcggcttccttttgtttgaagggttttgcgtttcaatgaggagattatgccgaaagtcagaatggaagtaaagcatcttgatgagaaaatttctgcccaccgacgaacggtcgtgctcgaccgtcgatggagggtgtgcataatcgaagtcgcacgacgcgaccggtgatgccccggcgaaccggggcggggtggttaggcggtgcgctcggcggcgcgttctgcgttacggtcgtgcgccatgcgcgcccatactgcggcccagcgcgctttatcggcagagttcggcttgtacacgtcgtcagggtgcggttccgggccgtaggcgttgcagctttcgtcgtattcgtaggtcatcatcttgccctcaaggggtcatggcccggcgaaccgggcgggtgattacttgcgatatttcttaataaggtcgtgtgccatggcgatggcatcagaataggtttctccgccggcctccatttccttcacagccttattgcgcagtgcgttcagcttgttgccgttgatggtgcctttttcatccttggcagcttcgcaggagtcgcgcagagttttcagggcttggtaggtggcgttcatcgtcttgttctccgggtt

SEQ ID NO: 11 - DNA, 66795 bp, artificial sequence
  BP1658
tcgcgtttcgatgaggagattatgccgatagtcagaatggaagtaaagtgtctgagtgaagaaatttctgtacaccgacgaacggttgtgctcgaccgtctgctgcggtgtcgatatactcggcctattgcgaacaatggactgattaaatgtacaaactcaatcctgcgctgcgagcggtctggcgaactcgtgcccgttacaaagtcatctatggcggccgggcgtcttcgaagtcgcacgacgctggcggtatagccgttttcctcgcggccaactacaagctaaagttcctctgtgctcgccagtttcagaaccgcatcagcgaatcggtctacacgttgatcaaggacaagattgaaaactcagagtataatggcgaattcatcttcaccaagaattcgatcaagcacaagagcaccgggtcagagttcctattctatgggatcgcccgtaacctgtcggaaatcaagtccaccgaaggcatcgacattctctggcttgaggaagctcattaccttacccaggaacaatgggaagttatcgagccgaccatccggaaagaaaactctgaaatctggatcatcttcaacccgaacgaagtcaccgatttcgtgtaccagaacttcgtggtcaagcccccgaaagactcctgcgtcaaaatgattaactggaacgacaatccgttcctcagtgagacgatgctcaaagtcatccatgaagcctatgagcgcgaccgggagcaggccgagcacatttatggcgggattccgaagactggaggcgacaaatccgtcatcaacctcaagtttattcttgcggccatcgacgcccacaagaaactcggctgggagccggccggatcgaagcgcatcggcttcgacgttgcggacgacggcgaggatgcgaacgccactacgctcatgcacggcaacgtcatcatggaagtggacgaatgggacggcctggaagatgaactactcaagtcgtccagccgcgtctacaacctggcgaagatgaaaggcgcctcggtcacttatgactccatcggcgtcggcgcccacgtcggttcgaagttcgccgagttgaacgatgccagccccgacttcaaactgatctatgatccattcaatgcgggtggcgctgtcgataagcctgatgacgtttacatgaagctgccgcacacgacgatcaagaacaaagaccacttcagcaacatcaaggcgcagaagtgggaagaagtcgcgaccagattccggaagacttatgaagcggttgagcatggaaaggtttatccatttgacgaattgatctcgatcaactctgaaacgattcacccggacaaactaaatcagctgtgtatcgaactttcgtcgccgcgcaaagacctggacatgaacggccggttcaaagtcgagtccaagaaggatatgcgcgagaaacgcaagatcaagtcgccgaacatcgctgactcggtgattatgtcggccattctgccgatccggaagcccaaaggcttcttcgacttctaaacatagaaaagcccggatcgctccgggcttcgggtcttactcggtgtggttcctggcgctgggtgtcgacgcaacggcctcgccgactcccagggcttcctggccggccgcgagcgcttcggcttccgactcgacgatgaaatcatcaccttggccatcgcctggcggaacctcgaccagcacggcttcttcgccttcgaaccgcaggtcataggtcttttcgacggacagaccgtaacgagcgttgagcgcgtcccagagctgggcctcataggtccgcaggtcttgcagagctttctggtggctgagcatggccatgtcaacggcccgttgcagggtttcatccaggacgttgaaccgaatgcgaagggaacgaatccgctcgacaacttccgcatccactacatgtctttcgatcactgcttttcacctttgctgaatgtaacgttgtagccgttgtcggccaggtaggtcagggcgccttcgaaggaagttccgacgaggtgctttagcttcatttcgcgttgcgcggccgaccagaatgccgttccggagaactcggcgcgcccctctgtcaagacccttccatcaggcccggcgatccgtacatgcacggaagatagcttgatcggcatcagtgaatacctccactggcttgcgacggcatgctttcagcgcgagcggcttcgcagtccgggcagggacaggcttggcggacgcgctccaactcgtcggcatccatgacatagagcttcccatcggcagtgtcgtgtgccatggcgatgttcgggaagtcggtggcgctcaggccggcgacggcgcggatttcgtcccagagcgccagattctcggcattcaggcgagcggcgagtgcttcgtgctctttagcgacgcgcgccatgaactcgtccatccggaatgcgaattccgcatcgatggcgcgggccgaggccatggagctgagtcgaatcggttctttcttcatggtgattctcttttggctggtggttgttcgttgctcaggcctattacagcctgggcagcgtgatgaagatgaacacaaaggctgcaaacgccaatagcgttccggtaagcattttggaatgactctgcatctcagcgtactgcttagtggacattccgtgctgcgccgcctcggccgcgaatcgggctttcgcctcgataacttccgggcgcagcgacaggacatattctaaggcctcttcccgcgctttttcggcctcgaccgacctagggtcgcgggccgagacttcgctgtgccctggcctcgcgggatgggcttgcagcgatggaggaagttcagcggccacgactccatagtcggcgcaggcccaagcgatcccgatgaggatcgcgaggatggattggacgattcgcagcataactttgtcgctagggaagctcatgatcaatcctccaccgaccgaacgatttccaggttgcgcccggcattggtcccggcattgaaggcgcgccgaccgtcgctatcgtccaggcgcatgagcttggtaacatttgacttcttgtagccaggatcgccgaaatgttcgtgcaccgcagcttccttcaccacaaccagagacgttccggcagaagataccagctccatgcgcttcctggtgatggcctgaaggcgatagctgatttcctgggtcgcggccaatttgaattgtgcggcaaccttgacgttgaaccgtccgtatccttgagccttctgatactccctgcacagacgatcaaccgcttcgacaagggagttgaacatgttcacagccagctcaacgtccgacttgtagcctttaaagcgtacggcatgaccccagcgcttcgtagtcccgccgtttgcggcgtgccaagaagccttagccgatgctcggtggtcgttgataccacctttgaagtccatgatgcagtcgttgtacgtcgccacggccactgagaagaacttcatccagttcgggattgcggaatagtaacgagtggctatctgctcgtcgaactcttcacgaatctcgccggtcgcttcgaagccgtggaggtcatacttgtccttcagcttcttcacacgctcggctgcaatggcggcttcgtgcgggctggaggagtcggccgccatggcagtcagtttgcggatgcggtctttcgccttctcgatggcttccggggtgaattcgttctggtcggtcatggtcggttccttttgtctgaagggtttcgcgtttcaatggagctattttgccttcattcagaatggaagtaaagcattttcttccactatttcggcattgactggaagaaattccaaatccaaccgcctgctaccagcaggaggatgagagcggcgaagaacaagacggcggccgcgagctgtgcgcccggcttcagcttgggatggctgagcttgggctctacgggaacggccggagcgctggcgctgcaaccggcatctcctgggccgtagccgatgccgcgttcacgcgcctggagcgacaccagggatttcagatactcggtctgcttttgcgactcttcgtagatgccggcgacggcgaaccagagggcgaacacgacggacgtacacacaacccaggcgccggtcagcaggagggccagcgggccgatgagaaagacagaagcggccaggacgattgcgccgccccatatgatgaagccggccagaccattggtgatgtcgatacagaactttttcatttttcagattccttcggttacgggatggaggggatttggaactctgcgccgccgagaacatcaatgacgacttcccagagcgtcggaacagaccactggtaacggtcgaagtcggtttcaggatcgacgcccagctgtacataggaggtggacggtgagccgtaactggcgtgtttccgcatgatcgttgccacgcggccatcgccgagcggaacagtcctgtgcggaacatacgcggccattgaataggactgcccggctgacacggtttcgcaattccgcatacgcagtctgaccgctcccaccgagtcccagccgcgaccgccacaggcctggcgcgctgaagagtgctcatatccttcatgagtcatttcactgaggtgcgccgagcggtccacgtaataactaacgttgtccatagacccaaccagcaccagggactcgaaaccgaaccgatgatcgtggatggaggatgcggcgatacaacgccgacgcggcaactccggatgccacacatggaggcgaccggccggaagttggacctggatgaaccccaggccgtgcagcgtgatcttgtctttcatcggatcagggacagtattcatagataatcctcagtagcagaagtgtatggtaagggttatgatggccaagccggccgcccacagaagggcgaaccaggtcatggctttgatggtcatgtagatcatccgaagaactttccggcgcagatcgggccaatgcccatttcgatggatgcatgattggtcaactcgcgaccgcagcaggagcactgaccagttttccgaccgtaggcgactgccgattccatcggcttttcgaacatcttcagaacgtcgtcgtactcagtgtcggtgcagtcgcgactcttgatgaatttgccattggtgatccggccgaggtagatgtcgcccaagacgtacaagctaccggcgttccggctgtgagcgctagcctctttcacaacaacgatgagcggctcctcgccttcgccagccaggcggattttcgggcgcttgattccagattctttcgccttctcaaacgccttctcgatgccggaaatgtccagagtcggcgcagcagcttcctgcgaggccactttctcgcgatacttggcgaggttttcgatggcgcgcttcgcagcagcgatctgattttctgtcaaggagccgtatttatacaacgactcctgaaggctctgagcgaagctgaaggaatttccagtccaccattcgatgatatccgggtgcgcggcttcgaaggccttaattttgaggtcgcgctcttgcgccgcgctacagattttctcgatgcgcttttctgccgccttagcacggctcttggcgcgctgctccgggctggttttgtactctttgtatccgacgccgccgcaggcgaagcaggcgcgaccataagacgaagggccacggtacaggccggtgcctgcgcatttggtgcacttgtcgcgatacagcttcacttccttccgggaattcgggcgagcgcccatggacgcgtcttccagggtcttcggcgcttcgttgttgatcgctacggtagcgaagtcgtcacccaggtcttcgaagcctgtgaacagattctctgctgcgttcatatcgattctcctgtttggaaagttcgtttcgatgagttgactatacgccagaaatggaaaacggtagcactttcgcactaccgttcgtcgggtcgcagagggtcaggctacacggatcaactgcgacatgactgccaggttacgctcggcgacgcctatgatgaggttggttccgatgtcgaacttccaagggtcttccctgttcttgtcgtagaacggatttctgaacagggtccgccatgtctcttcagtgaagaacgttttatggtccaggtcttggtgggcgatgttggagttgtagaacggcacgacgacattgagcgtcgcgccgaccgccatggccctctgcaggtctttcaccagatcgatgacttgggctccggtgagatgttcgaagaagtgaaatgcgtagaccgccgtcaattcgccgtcttcatacggcactcggccgctggcgccgtcccagttcggccagtcgagcgattcgacgccgggaatcggcgaattgcctgcgcccaggtttactgcgcggcggtgatccggctcgatcagctgagcgatgtcgcgcttcatgccgagtttgaacaggttttgaatatccattttgctctccaggttgctgttagtaaatgtcgctgttgatcttgaatccatgctcagcgccgtcgttgtagtcatactcggcatagctgtcgcagtaatcgttcaaatgttgaatgatgccaagaacgtcgttcgcggccttgtgccgtttcgcggcgatggtcttggcgatgctgtcgccgacttccagagtttcggccgtccggcgatggataagcagacgactccaaagatagagccggacgcgacgaataatgtcgcgatggcgctccagtcgtccgtgcaactcttcaatttcgttctcgcgagatttgacgactcgtcgaagctgctgaacttccaattccaaatcggccttagtagccatattcacctcagaaaggaaaatcgtctggaactccaggaagctcgacgatcattgttgagcctgagcggtctagaatacatccgaccgagcctgccctatggggatagtgcctacacgaactgtaacaagtgacttccctgactattcgccaggtcgatcctccgcaccatctacaaattggtgggcgcttcgactcaagttttcgttcgtccaggatggcgcgtctatcgcaggaaaggcaacgcgccttaaccgacgtggccatgggtatagtcgatcattcggatgagttcatcatcctctgattctctcgacttcagaccgcccaaagaatccgactggccgttgcatttcgcatctacatccatcgaagacaggaaacctgctgacactacggtgatatcaactttgtcgccggccttcttgaagccttcgcactcagcatcgagggccacaatcgcactcgcggccatgttcacatgactgatgaggtcggggaagatcacaggaacttcacgcgacatgccacggacagtcatcttcaggactacatacttcatactcactatcccttttgtatgtgaggaaagaactcgctgttctccggatggtggaaacgctcgggcgcaggcggtctttcttccggacattgaatcgtcgaaggcgggaaaaccgcgccggcgataatcgccgcgaggagcgcagcggatgtcgacatccagagggcggtttccaggcttacccgaactccaggacggcgcggcttcattcgctccaccctcttcccggctcataggatggtagactgccgccgcgaatccaattgtcccacatatggttcagaccagtcggtggctggggcggcgggctgtagaatccgggaacttcggtgctgctcaggaaataaggcgtgcaaacggcctggacgaccagttggtgccgctcccacattttatcaatcgctcttagcatgacgtcttcgcactgagccttgctgtcgaaccgtctgctagtatggtccggcatctggacgcagccgtcgccagtgcaaaggaaagcagtagcaatccatacggtgatacttgccatttcgtcaccctctttggttgatgagcagagtctattccatctgctcgccaggagtaaagtgcttttcgtcgggataaatgccgatgatgtctgcgtcaagcatccagatgtccacggacggatcgtcgctgctgatttgatataggttgtacagctcccgtccgccgaccgcgcgctcgcctcgcggctcaaccgccagaaccttgccgtgcccttcaccgtgctcgtccaggtatatgacgtgatcgccgacttcatagctttctttcgtgacgaggcgtgaacgcgagctgttctgcgattccaccacccaggaatccagcacgccgcctttcatgtcgcgaaacaatcttgccgatttgtcgcaatcgaacacgcccagaacttcgccgtctttcaacacgatatgtacgataggaagaagagtattcatgtttaatctccattgactgataattagagtctaatctgccgaaaagttcccgtaaagaattatttctcagaactgattagttgcaactgttaatctgatgtatgtgtttgaatctcttttgaacgtttgatgtttcccctataataagcgcacacagccaacaaccacgtggaactacaatgtttaaactttcctggatattcgggcgcaaaaaggatagtgctgcctgttctgaatcggcgccggagaaagtcgcacaaatccctcaacacgatccgctcgaccctatgattaagctgggcagaattcgcggctggaacgtcgagccggagaaagccccggtcatccgtagcgtgaaggatttcctggagccgggcctatctgtcgcaatggacagcgcgtatggtgacggaccgactccggccgcgaaggctgctgcgggcggccagaatccctatgtcgtcccgaccatgctgcaggattggtacaactcccaaggcttcatcggacaccaagcttgcgccatcatttcccagcactggttggtggacaaggcttgttccatgtccggcgaagacgccgcacggaacggatgggaactcaagtcggacggccggaagctatccgatgaacaaagcgcgctgatcgcccggcgcgacatggagttccgcgtcaaagacaaccttgtcgaactgaaccgtttcaaaaacgtcttcggcgttcgtatcgcactgttcgtcgtggagtccgacgatccggactactatgagaaaccgttcaatccggatggaatcacgcccggctcctacaagggaatctcccaggtcgatccatattgggcgatgccgcagcttactgctgcctcgacggccgatccgtctgccgaacatttctatgagccggatttctggatcatcagcggtaaaaaatatcaccgcagtcacctggtcgtcgttcgtggaccgcagccgccagatatcctgaagcccacatatctcttcggcggcatcccgctcacccagagaatctatgagcgcgtgtatgcggcggaacggacggcgaacgaagccccgctgctggccatgtcgaagcggaccagtaccattcacgttgacgtggaaaaagccatcgcgaatgaagatgccttcaacgctcgtctggcgttttggatcgccaatcgcgataaccacggcgtgaaagttttgggaattgatgaaggcatggagcagttcgacacgaacctggccgacttcgacagcatcatcatgaaccaatatcagctggtcgcggccatcgccaagactccggcaacgaagcttctcggcacttctcccaaaggattcaatgccactggcgagcacgaaacgatttcttatcatgaagagttggagtccattcaagagcacacattcgacccgcttcttgaacgccactatttgcttctggcgaagtcggaagaaatcgatgtgcagctggaaatcgtctggaatcctgtggactccacgaccagccagcaacaagccgatctgaacaacaagaaagccgcgaccgacgaaatctacatcaactccggcgttgtgtctcctgatgaagttcgcgaacgtctgcgtgacgatccgcgttccggctacaaccgactcaccgacgatcaggccgaaaccgaaccgggcatgtctccggaaaacctggccgaattcgagaaggctggtgcacagtctgcgaaggcaaaaggcgaagccgagcgagccgaagcccaagcgggcgccgtagagggcgcaggcgggcctgttcccgcagccccacgcgggactaaacccctcgcgaaagcggccgaggaaggggcaggcgaggccgctgcacagccgtcgcggccggaccccgaggccgagctacggaacttgttggctgatcttttgtcgaagctccgagatctggacgacattcaggcgccggacggcgtagacatagagcacaatgatgcgccgggcctgaagcgcacgtcacaacctggcgtgtctggtatggaaccttcggtgttttcgtccaaccgcatcgtcggtcctcgtgatcattcggaactccagaggatcaaggttaatggaataaccaccttgatcgaaaatccgcgcggaagcattcgacaaggaaaggatgggagctggcgagttcagatgaaacatcactacggattcatcaagggaacgaaaggtgctgatggggatgaagtcgattgtttcgtcggtccgaatctgggctccaaacgggtcttcgtcgtcaaccaggtgaacaaggaagggcagtttgacgagcacaaatgtatgctcggcttcaacaacatcaatgacgcgaagtctggatacctgtcctgcttccgtccgggttgggatggtctcggttccatccacgaagttgacctgcctgccttccgtcgctggcttgcgaacggcgacacgaccaaaccgtttggaggcgagtgatggcattcaaggcctccaaaaagcgcgagcgccgggcacctcttccagtcggaagagggaagcccataattccatcggcaggaatcgaggcctggtatcgaaagcagatgaaggacatgtccaagctcatgatcgccgactatcgaagtgagattgagaaggcgctgtcccagcctgcggccgaacggttcttcgccagcgacgaatccgttaacgtcctgttcaagatgactcttcgaagcctacagcagcgatggagccgcatccttgaaggcttcgcggccaagattgccccggagttcgtcaaccggaccgacgaagccgcgaccgccgcgacccttcacagcttgtcggtggccggcgtcgatcagccgcgagctgcgtacaatgagagcgtcaggaacaccctggaggccgcgactacttataaccacaccctcatcaccagtattcaagaggaagtccacgagaagatttacacatcagtaatgttgtctctgacttccccaaatccggaagagcaaggaacttccggcataacaaacgcacttcgcgaagtcgggaagttttctgaaaatcgaatcgaactcatcgcaagagatcaaaccagcaagctttacagttcgctgagcgatgagcgaatggcggaaaatggagtcgaggaattcgagtggatgcactcgtctgccggcaagactcctcgccatacccacctggagaaagatgggaagaggttcaaactgaatgatcccagactttgggagggtccgaaagcggaccaggggcctccaggatgggcgattaactgtaggtgcagaaagataccaatcatttgatatcgataggagcgcgatatgccgttagttcatggcacttccaatgaggcccgttctgaaaacatcaagcgggagatcgaagccgggaaagacccaaagcaggctgcggccatcgcttactccatccagcgcagtgagaaaggtgagatggcgaaagattgttcgcctgagctcgtcgccgatcttcgcgccctggtggacgctctgtcgaggctcgtgaaatgaaccgcaagacgtgccggcgccgactcgcagtagatgtaatcagggccaacattcacggcggattcttcagcctgaagtttgccgccatcgatttggcaatcatcggcgtcgccatcttgatggcttttggccgataatactgagaaatctggattctgactaaaaaattctagtccggatggccgaaattaccgttaacggaaaatagcggtaatttggaaagcctactgccgcgaggctttaacagagcaagttcctaatttccggtttagccgcgtgcttcaaaagtatatagcgtgggaaattagaagtaacgttccaatagaattcatctataagtaacgttataacataacgtcattttatctgctctagacgtattgaaatttaattttaaatcggtaaattggtaatttgaattagtttaggagttgaaagcctcgcggcagtaggcttagacagatcccgtcaagttccctagaccaaattaccggattttcgcggctgaggaaactggtaattagatcataatacaaattataatgtaagttaacagtcgcggctacatctaattattgttccgcttatttacccctagatgtactgcgtatataatacagccatagtccacgactcttcgaattaacgatggcaaagtcgaaaagaaaaattgacgaaaatggatatatgacaatcgagggctgcccgatcagctcttatggcgtcttccaatattctgctggtcaactcggtcttccgggcgatccgatgcggattgtcaacgtatatcgcccggagtctgccgtcagcgatcctgagtacatcgaatctctgaagaatctcccgttgatcgacgagcatgagatgctgtcgggattcgacgacgatgacgacagtgtggcccccgaagataaaggggtggagggcatcatcacctccaacgcttactacgaagccccatgggctcgcggcgatatccgcatctattcccgcaacatgcagaatcagctggaaaggggcaaagaagacctgtccctaggctatagttgccgctacactgagcaacccggcatctggaacggaacgccttatgaagtcgtccaggacaagatgcgcggcaaccacatcgccctggtaaaagagggtcgtgtgccgggggccagagtattggatggtctgtgttttgaccatctcagttttgatttcagaccatccgatgagggtaatgaaatgagtctcaagaaagccaagcagaagccccctgtccagcgcgtagggcaagctgctgactcggcggtcgaagagttgcgcgccctgtggccgaagctctctgcatccgtccagaagttcctgggcgaagaggcgcaggagccggagcatcaggaaggcgcagccgctccggccgaaccgaccgacagcgagcaaattaccgagcatccgactctggaaggtgctcagaaggacaacgaagagcatgaagaggcgccttccgttgtcgatccggccgtggccgccgtcgagccggagcgtcaagaaagtgccgcatccgaaatgtccggtgaaggcgaagtcgccgaactgatcgcccaggtcaaggccattctggctcgactggagggcacggtagccgaaggggcggacaaagagcatggcgaaggtcaagatgtcgtcgagggtttggaggagcagagcagcctcagcggctcgcaaaccgccagcgacgatggtggtgagggcaaggataacagcgaggaacttcctgaaatggcacagaagaacgcgcaagatgctgcaattcgcggtctctatcgcgacattgctgctaaagatcgcctctacaagcgtcttagctccgtggttggcgcgttcgatcacagagctatggactcggctgaagtcgctgtttacggcgtgaagaagctgaacataagctgcgcgaagggccaggaagctctggcactcgacatgtacctgaaaggcgtcgaggcctcacgtggcgctgccagccgtcaatcgaaagcccaggattcggccggttctgctccgcagtgcgccgagctggacagctacctgaagggggagtaactcatgttccagaaacaagtttaccgccagtacactcctggttttccgggcgatctgatcgaggacggcccgaagcgggcgcggccgggtcgaatcatgtctctgtctgccgtaaatccggctgccaccgccaccggccccaaccgcatcagtcgcgctttcggttacgccggtgacgtcagcgccctcggcgaaggtcagccgaagaccatcgcggctcgtgcctctgaagtcgtgatcggcggcgccaacttctttggtgtcctcggtcatccgaagcactatgccctgttcggttcggccggagactccctggctcccagctatgatctgcccgatggcgccgaaggcgagttcttcgacatggccaccggcctggtcgtcgaaattttcaacggcgccgcaaccgccctggacctggactatggtgacctggtcgcctatgtacccaacaacctgcctaccgccgacaacgcgcttggcctgccggccggcgccctggtgggattcaaggctggctccatgccgaccggcttggtccagattcccaacgcacgcatcgttaacgccatcagtctgccggcccagtcggcggggaatttggttgctggcgttaccatcgtccagctcacgcagtaaggaggcgtcatgagccagatcagcaagacccattcgcgcctcgcaggccgcaatgcgaaacctttcgacctgaaaaacatcaccaatgacgccgtggcgtctctgagccgcatcggcctggtattcgatcacgccgtggtccaggaccagatcaaggccttggcgaaggccggcgcgttccgctccggctcggccatggacagcaacttcaccgccccggtgaccacgccgtccatcccgactcccatccagttcctgcagacctggctgccgggcttcgtgaaggtcatgaccgctgcacggaagatcgacgaaatcatcggcatcgataccgttggctcctgggaagatcaagaaatcgtccagggcatcgtggagccggccggcactgcggtggaatacggcgaccacaccaacatcccgctgaccagctggaacgccaacttcgaacgtcgcaccatcgttcgtggcgagctgggtatgatggtgggcaccctggaagagggtcgtgcctcggccatcaggctgaacagcgccgaaaccaaacgccaacaggcggccatcggtctggaaatcttccgcaacgccatcggcttttatggctggcagagcggcctgggcaaccgcacctatggtttcctgaacgatcccaacctgccggcgttccagaccccgccgagccagggctggtccactgccgactgggcaggcatcatcggcgatatccgcgaggccgttcgccagctgcgtattcagagccaagatcagatcgatccgaaggcggaaaagatcaccctggccctggccaccagcaaggtggactacctgtctgtcacaacgccatacggcatttcggtttctgactggatcgaacagacctatccgaaaatgcggatcgtgtctgctccggaactgtcaggcgtccagatgaaagcccaagagccggaagatgctctggtgctcttcgtcgaagacgtgaacgcggccgtcgatggaagcaccgatggcggcagcgtgttcagccagctggtacagagcaagttcatcaccctgggcgtcgaaaagcgggcgaagtcgtatgtggaagacttctccaacggcaccgccggtgcgctgtgtaagcgtccgtgggccgtggtgcgctacctcggcatctaaccgatgcctattcaccaaaggccgggtttccggcctttgttcactctgactctgactcggttgtaggggccggttagggcataattactaggactacgccaatgactgtttacatcgtttccgccatgactcaatccgtgtcttacaatgcgtatgacacctctgatccgtccaatcctcgccttcagcgaaagattctgattcgtggccgcgccggcatcgcatccgaaacttccggcttcggcgacatgatttccgacgcggccgggcgtccgatctggaccccgcagggcgattgtactgccgtgagcgattcggatttcgagctgctccaggcaaataagattttcatgcgtcacatggataagggttatctgcgagtcgtgaagaccgacatcaccagtgaccaccagcggatttccaaagagactcgcaccatggagcgcgatggattccagcctctggacgctgctcgtctgcagcagaaaatcaaggtgactaccgccagcgcttcccaggaacaagagttccggatttaaccgagggtttcggtatggtgattttcgacgaacataagtttcgcacgctgtttccggagtttgctgatccagccgcttatccggacgtgcgcctgcagatgtatttcgacattgcgtgcgaattcatttctgatcgcgattcgccataccggattctcaatggtaaagccctggaagcctgtctgtatcttctgaccgcccacctcctgtcgctgtccacgatgcaagttcagggcgcggctggaggtggcgtcactgccggtgggacccaaggcggtttcatcaccagcgctacggtcggcgaggtcagcgtggccaagctcgcgcccccggccaagaatggttggcagtggtggctttccgggacgccttatggccaagagttgtgggcgctcctcagcgtcaaagcggtgggcgggttctacatcggcggtcttccagagcgccgaggcttccggaaggttggaggaacgttctggtgattcctggtgcgaatcttctgcgaatggccttcggggtcatcggtactcaaattgtgaaatatcgcaagtttgagcagcgagtgaagaatgatcaagctcagtacgtttccatgttcgaggagcctttcgacctggcagcgtctgtccagcgagtccgacgcgatcagtatgtccagtttaatctggagttccaacggaattatgttatgatcttcgccaactttgagatggttgacttggatcgcgatgtggccggtgaccagttcctctggaccggaagagtttttcagctggagtctcaaggctcctggttttatcaagacggctggggagtttgcctggccgtggatatcggtgcggccaagctcactgatgacgggaaaccgactttctaggtgatgtatgtttgacggcgaactgatagcgaaaatggttgtcgagctgaatgcggcgatgacatctgctcaagaggctttgcagttcccggattttgaagtcgtccagaaagctcagccgacccaacagggaacgtcaaccaggccgaccatctttttccagaaactgtttgacattcctcgcggctggcctgccaccgattggcacctggacaacacggcccgcaaatatgtagaaataactcgacagcatgtagagacgactttccagattagttcccttcattggcagaatcctgaaataactcacgtggttacggcttccgatatcgccaactatgtgagggcttatttccaagctcgatccacgattgagcgcgtaaaggaactggacttcctcattcttcgcgtgtctcaaatttccaacgaagcattcgagaacgacaatcaccagttcgaattccacccaagttttgacatggttgtaacttacaaccaatatattcgcctgtacgaaaacgcagcatattcggccgatggggtattaataggcatatgagtctgaggcgcgattcagagctaatcgccgcgcacctccagatgttaagagccatgcgcggcaggtccgtttcagccggatggtattccacggctcgatatcctgacaaggcaggcgggtcggtcggaatacaagtcgcgagaatcgcacgtctcaatgagtacggcggaactatcgaccatccgggcgggaccaggtatattagggacgccattgttcggggccggtttgttggcgttcggttcgtcagaaacgactttccgggagaaaccgaggtaactaagcctcacagaattaccatcccggctagaccgtttatgcgatatgcttggaacttgttttccgcagatcgcgccgcaatccagaaccggatagccatgaggctggccagaggacagatcactccagatcaagctcttgcccagatcggcctggcgttggaaggatacatagccagaagcatcaggaccgggccatgggtggctaactcagcatctacggtcaggagaaagggattcaacagaccgctggtcgatacggcgcacatgcttcaatcgatcagcagcagagtaacataaccaggagatcatccagtgatcagtcagagccgttatatccggatcatttcgggcgtaggcgcaggcgctccggtcgcaggccgaaagctgattctgcgcgtcatgactaccaacaacgtcatcccgcccggaatcgtcatcgagttcgacaacgccaacgcagtcctgtcatacttcggcgcgcagtcggaagagtatcagcgggctgcggcttatttcaagttcatcagtaaaagcgtgaattcgccgtccagcatcagcttcgctcgctgggtaaacaccgccatcgcgccgatggttgttggtgacaatctgccgaagaccatcgccgatttcgccggcttctcagcaggggttctgaccatcatggtcggcgcggccgaacagaacattaccgccatcgatacgtccgccgcgacttctatggacaacgtggcgtcgatcatccagaccgaaatccgcaagaacgctgacccgcagctggcccaggccaccgttacctggaatcagaacaccaaccagttcaccttggtcggcgccaccattggtaccggcgtcctggccgtggcgaaatctgccgacccccaggacatgtccaccgccctcggctggtccacctccaacgtcgtcaacgtcgccggccaggctgccgatcttcccgacgcggccgttgccaagagcaccaatgtcagcaacaacttcggttcgttcctgttcgccggtgcgccgctcgacaatgaccagatcaaggccgtgtcggcctggaacgctgctcagaacaaccagttcatctacacggtcgccacttccctggcgaacctcggcactcttttcgaattggtgaagggcaacgccgggaccggcctgcatgtgctgtcggcgactgccgccaacgacttcgtggagcagtgccccagcgagatttttgccgccaccaactacgatgagccgggcgcttcgcaaaactacatgtactaccaattccctggccgcaacatcaccgtttccgacgataccgttgcgaacaccgtcgacaagagccggggcaactacatcggcgtcacccaggccaatggccagcagctcgctttctaccagcgcggcattctgtgcggcggtccgaccgatgcggtggacatgaacgtctatgccaacgaaatctggctgaagtcggctatcgctcaagcgcttctggacctgttcctgaacgtcaatgcggttccggcgagcagtactggtgaggcgatggtcctggcggtgctgcagccggttctggacaaggcgaccgccaacggcacgttcacctatggcaaggaaatcagcgccgtccagcagcagtacattacccaagtcaccggtgatcgccgtgcctggcgccaagtccaaaccctgggctactggatcaacatcaccttctccagctataccaacaacaacaccggcttgatcgagtggaaggccaactacacgctgatctattcgaagggcgatgccatccgcttcgtcgaagggtcggatgtgatgatctaatggtttgcggcggactcgatccgccgcaaccttccataaatggagtgaggaataagcaatgatcaacatttctgcgttcggctcgatctgccagttcacggcaagcagaactttcccgaacggattcaccgtcaccgagttcgccgacgatgccgatcccatcgacagcccgccgttcaccgctgccgataccggcgtcggtctcaacggtgacatggtagtttggaaccgggcgaacatcctggaagtagtcgtcaacgtcattccgaataccgagggcgagcgcaacctggcagtcctgctggatgccaaccgcaccggaaaggacaagtcgggcgctcgtgatgtcgtcggcctggtcgtggcgatgccggacggcagcaaaatcacctgcaccaacggcaccccaatcgacggcgttctgatcaacgcggtggcaagcgtcggccgtctgaagaccaagccgtatcggttccgatttgaaaaagtgatcaaagccggtactagctgatgaagaaaattccgctgacagcagtccccaatcaagcgatctcatttaacgccggtagcagctattggaagattcgcctgtaccagaacatggacatgatgaatgccgatatcagccgcgacggcgtgatcgtttgccatggggtccgctgcttcggcgggattcctcttctccagtacagccatcagtaccgacctgactatggcaatttcgtcttcgaccgcgacgccgattggacattgttcggcgacggcaccaacctgttctatctggacggcgccgaattcgccgagtatcaggcgcttgccacgaggaaagaatgagcacatcaacgatcagaaccgggacgaacaacgatatccttttggacgacaatggaaacatggttatcctcagggatgtcgaagcgtgcgcccaggacgttcgggcggcgatgctcatgcgcaccggcgaaaacattttcgatgtgaactccggtgtgggatatttcgaatacatcttctcgccgcagaaaagctatgatgacgctcgcaaatccatcgcggatgcaattttgtcctcgccggatgtgaccggcatcgagcagctggacatcgacatcaccggggaagtcttcggcgtcgatgctaaagtcatcaccatccacgggcctgttaccacaggagtttgaaatgagcacaatccgcatccaatacgccaacggcacccagctgttcctggacggcaaaaatccgccgctcctggaccctctaccctcgttcaacccgtctgtagaagatctggaaggcctggaccgcgaaaagaacaccggcaagggcgactcctcgccggccggtcttcccgttcccccggtaaacgtcgattccaatgtcgacaacggcggaaccatcccggctccggtatcgaccgacgctcctgcggccgaatcggccccggaaggcgcccaggaagctcctgcagcgggccaaggcgacgagaaaggcgccgaggaagccccgactaccgccccagtagaaaaggccgaggaaacggcctcgccggccgctgaagaggaagccccggctcccgccaaggccacctctcgcaaaaccaccagcaagtaaggactcgacatgatcaacgtcagcggcttcggcacaggaattgtaatagtttccgcctcatcgttcccgatggggttttccttgtcgaagttcgctgatgatgagagtccgatatcctccaaagagctggagccgttcggatatgagatgctttatgacggcggcctattcgcctttgacaaggctgctcctctggaagtatctgtatccgtcatcgcagggagcgaggatgatattaaccttcgcatccttctcaattccaaaaagggatcattccgatttcttccgggagtcatcccggacatgacgactctcgtggccactcttcctgatggcggccgcaccgttctgtccaatgggaccatcctcaagggtccggccatcgacaccatacagaacaccggacggcgcaaaggcaacacgtacacttttgttttcggtagctatcttggcgcccagactgcgcgtcaagccatttctaacgttatccaatcggtactggaggtggtctgatgttagggattttcaccagcctcctaagttcgcgatctttttcgattgtggaccaaaacacaaaccagctagttgctgcggatttgaggataggccgggtcaacacccggttttcttctgtagggcaacgtcacatgctggaagatggtacgaccaagatggattccagaacgatccaccctatggaaatcatcgtcgaagtattttgcccttcaattgatgtcgtcgatcagatcaatcaattgctcctggatcgcgacacactgtacaaagtcatcactcgcggcatggtattcgaacggatgatgtgtaccagcgaagcgctcaatcagactccggatatgatatcggcgactcctgcgcgactgacattctcccaagttctcgtccagaatcccaagcctataatgttcagaaatgcaggggactcttctatgatcgaccgagggctggccctagctgaagacgtggttggctcggccggcgatctgttcgactacgcagtaaacggcgtccagaacgccgcagacttgttctgaggtgccaattgaactctttcctcaagtctattctcaacacgcctactctcaccatacgcgatgatgttaccaaacttcctgtcctttcctcaagtctattctcaacacgcctactctcaccatacgcgatgatgttaccaaacttcctgtctggaagagtcttcaagtcaagaaagtggaaatttactcgccggcttccgtagtgtcgaaacctctggcgacgaaagaccagacggaagctcaagtgtacaccgaagctctggacattgatgtgaagaatggaaagatcatccaaccggtgcgactccgcatcaatgctatctgtccggacctgtccaccgttgaaagtatcatgaacgctttcaatgataacacctcgactttcgccatcacttctaagtcgatattggccgataaaatggccatcatggcgctcgatgtagatcagtctccagacatgttgaacgcggctgagatcaatatggaattcgagcaggttgagcctccagtattgaatgaattcgatcctgcgttccctcaagatagtccgacttatggggtacagattcaatctctttctgatgctaatttgctggatttgggcgccatcggcgattcgatatcttcggccgcaaaatcgctatataatcgcgtgaccagctacttctgaggatgtatcatgcttgaaatcaatcttcccgatggccgtcaaactcgcgtacaaatcgaggcgtggtcggcattggatggctgggacctccagcgccgtttcgtcgaattcgctgtcagccaagattccgacttccgccgctctttcaccatggaaatcctgggctatgcgaaagtgctgcttggcgacgatgacgccggcattccgctgaccaccgcggcagtcatcaacaaccacctcggccactggaagaacgtggaactggttttcaactctgttctcaagcacaatggcatcgacccggccacgcacgccgaccggccggactattgggaacaagtcggatcgcagatggccatcgcatttctggccgaggcgtccaagctcattggtccagcaatgaagatcgccgaaggactcgccaacaagccggagtgattcatgtctagtgatttggatgaattcatacttcggtatgaggccgatactgccagagccgagcgcaatctggagcgcctccagaaccagatcaggcgcgtgaacagcgcatcgacgagtggccttcaggatttgcgccacttcgcagacggcgcggccacagaactcggcagagtcgttccgcagattgattctgtgacgagcgcaattcgcggaatgaacgcacaactggcaataggcgccactggcgtggccctggtcgcggccggcgtcaaggcgttcatgaacaccagggaccagtacaaccagcagcgcatccaggcgatggacataggcatcgccccggcacgcttggaagagtaccagagaaaattcgttcgccagtccggtggaaccatcagccgcgagcagggcgcggagctgactaaaaatctggcagacactttccggcgtgcttatcgcgatatcgggcgagtcggcccggaagcgcgaattttgcgtatggccggcgtcgatgtcgggagcttccaaaagggcatgcggccgctcaacgacatcatcaccgatctggccacgaaaatggccaagctgaagccggacgaaatttctgcctacgctgatgcccttggcgtctcgcgagattacctgagcaccctggcgaagatcggcccggccatgggaaaagtcactgagctgacgactgcggaactccagtccagggtccagggcgagtccaacatccagaaattcaacgatgccctggcgaatctcagccagacgttcactaccctggaaaaccgagtcggcgaaaagctcgcgcctgcgttcaccaagctgatcgaaatcatcgacaagatagtccaggctattcccaatgaagtggaaagcttcgcgaaggacaccaaatcccgttgggaagatggagtgctcgggaaggcgaccgttggcagtgatatcctatccctcctcagccccggcgccctgctcggtcgcctggcagcgtgggggactcgtcgcggcatggaagaatcagggctcatcgacaaggacaaggttcccggcgctcaaaccagcgaagacctggccaagaaacaagaagaccaggacaaggctactaagtccatgaaagagctagagaagctggctgaccagaccacgaagtctaccaatgattttgcggtggcgatcaacatgttcagtggcgcggtatcgtcgttcgcgaatgccgttgacgagcgccaagcttgggcagcctgggcgggggaaattggtcgggcggtcggcatgggaagcaccgcgccgacttcgcgggccaccggcgtctatccgcacgcgatctatgatcagtcgaagagtggcgcggccggacaggtcttcggcgagccaatcggcgcccagtctcttcgcaatcgcatgttctcgccgcagcgcaaggcagagccggtcaccgttccatcgtacatcaacgatatcatcaaagatgcttcgaagatgtacaacattcctgagctggacatcaagaaactcatatacaccgaaagccgattcaacgccagggccaccagcgaagccggagctaaaggcctcatgcagctgatgccggaaatcgccaaggcgtatggtatcactgacgtatatgaccctcgccagaacatcctcggcggaacgcgcctactgcgggaaaacctagatcgagcaaatggcgacatgcggttggccttgacctactatcatggcggactcgatccgaagaactggggcccaaggactcgcgcatatccgggtttggtaatgagcgctccaatcgagctgatggaagaggctcagcgcaagcagaaggctgcggccatgaccgtcgccaacgagacgttcgccccggaaggcggcgacatggacattcgtccctatgatggcgggcgactggaaaccccagaccagggcaagaaggaagatgagcgccgcgaagcccgtcgatatgacgacagggttgtgcgaccggaaattcgcatcatcgaccgcatgccagaccgcagcgacggcgaaatcctcaagatgtctagacgtcaagaggccgaccgggcagattctggattccggaagttcccgaatcaagttcgcggcgagaccaagcagaacatccaggctcaactcactgcaggagccatcgcgcaagtgatcggcgttaaccccaaccagatcatgcgccgcgaaatcagccgttctgacttgctgttcggatacaaccaagccatcctgggcaagcaacaggagatcaaggccgccgcgaccgaagccaacaacgtattcctgtctccagccaagcttgccgaagccacggccaaggtgaacgcagcatcgcgagaaatggatattctcaggacgtacggcgagcaacttctgaagagcgctccagagcgcggccaggagctgaccatcggtcgaatcgacatgttggtcaacgtcaccggcgcgaattctccggaagaggctcgcgagatattcagtaagcagactgcagaccagctgactacggcaatccaggacgctcaaaacgattccgcaactaagatactctactgatgaaaaagagaattctgcgagtaacattcaacatgccttatggacccgaagtcatccgcgaagatctggatgttcgagtccggattatgaaggctgcgttgcggattcagaaccgggcgacgatggaaattttcggcctcaccactcagctgcgcgagtctcttctgtcgcagttcaccgcgtggaagcaccggcaacgtcaagtgggcagggaagatgaattgatgatcaaggtgtcggtggaagccggctactctgaccaggggcgcgagcaagtttccagagtctttgtcggcgaagttgccattgtagatatcatttctccgccaccggacattggaatccgcatccagtgctataccaggcaaatcgacaggacgaagaccattcggaatatgccgcccgccaacacgacgtttgtcaagttcgtcgagtggggcgcgaacgaaatgggattgaacttcatctgcgataccagttacaacgatcaagttctgaagaatccgggccggtctatcactgtcgcgtcggcaatcctggcgtcgattcaggacatgtacatgccggacgtggccgcgttcgtcgatgatgacatattgatcgtgaaggaccgcgataaagtcattcgtccggatgaggtgaccaacgtcaactcgtttgttggaattccatcttggtctgaatggggcgtggaattccagtgtctgtttgagccatcgattcgtgtggctggaggcgtagcggtcgaatctctcatgaatccaagcgtcaatggtaactatgtaataaccgctctggaatacgatttggcaagtcgggatcggccgttctatatcaaagtcatggggagtccagcagcataatggccagggaaatcaaatcgttcaacatgttcggagttcactatacttcgcggcaattctctgctgtcgatgggctcagcatgatgtcggaaattcagagcgtgccgccagaagaattgctcaagggcaccgatgtattggcgcatccggaagaccatccggaaggcatctggcttccattgaccgctgcgaacatcaatctttatgtcgttgaccgagcgaaagtaatagctcccgtacaagttcttgcactgctgtcagaagtggtaatcgactggaactttggttttctcaaagactggaccggagtcaagattccatccagatttgtcgaagatatcaaaagtgtgaagacggcacattcaccttctgtagttgcgagtttggtagcgaacggttcggcctctatgcgcgagttggaagagtattattcgactcaagatgcctttaagatgatagatatcatgacggcgaagagcgtgaacgaggccttggcgtccgaagcatcgcacaacagaatcaaaaagggataattcctaaccgggcctgggaaggctatactagacctgcaaaatcagaggctttcccatgtccaatatttctctaacatccgcaaaagctcccgacaggacgcgactgatcgccgctcttgacgctcggtcgcggcgggatgctctagatttcgaagtaatgataccggctcaggttgttcaatatgaccgggccgagaatatcgcgacgattcaacctctcatcacctgggttgacactgaacacaacgccgtccaaaggcatcagctggttgatattcctgtaatttccatgggggctggcggcttccacataagtttcccgattcagcaaggcgacataggctggatttatgcggccgaccgcgacacgtctcagttcctggagtcgttgtcaatgtcgaagccgaacaccggccgcatccataagttcgagcatggcctgttcatcccggacgtattccgtcgatacaccatcaattccgaagattcggccgctatggtcatacaatcgacttccggagcgaccagaatttcgattcgcggcgataacatcaagataactgcgccgtcgaacgttactgtggatactccgcaggcgaacttcaccggcaatgtgactatcgctaacaccctggtcgtaaacggcatcaacgtgaacaaccacggccacctcgaaaacaacccgcctgatgcccggacgaaaggcggcatgattgcttaaggagattttcatggcaagttttgatttttctgatttaacagcggggggggggttgtaatggctaactacaactacatcgtcgatactggtgtgatagtcgcagataccgccgacgttctgagcgacgttgaggccgagttccgcgccgccctcggtgccaatatcaacttggccgcgagcactccgcagggatcgcttgtcgcggccgaggccattgcccgttccagcgtcatgcggaatgaagcgcgaattgccaataccataaacccgaacgtttcattcggaacgttcctggacgcgatctgtgccttgatggggatcgagcgtggttctgacctgtcaaccttcggctatggagttcaagtcaccggccgcagccaaacccgcatttccacagggtctagggtccagactccggccggcgcgatcttcacagtgatgagcgatgtcacgatccctgctggtggtgtcgcgaccatcgatatcaaatcgcaggagtatggcaacattcctctgccggtcgggaatctcatcattatcgacggaacaattggctggtccggagcgaaagtcatcgcttccactcgcgtcgatccgggcagccgccaaatgagcgatgcagaactgaagaatgcccgcgttaatcgattggccatccaaggccgcaactcgaccatggccatcaaggcgtatgtgagcgccgttccgaatgtcacgtcggtgaacgtaatcgagaacaacaccggcgccgttcaagtggtgaatggagtatcgtttacccttccgtatgctgtttgggtctgcgtcgccggaaacccggataaacaagcagtcgccgatgcgttgtgggccgcccataacggcggaactccatgggactatggcgcggtgaacaacggcgtcccggtggacgggccgaatggcgttcctgtgcgcgatccggcgtccggccgaaagtatgtcgtgaagtggaccactccaatcatgtacgatggatatgttaacgtaaccgtccagcaaggctcctcctctgtagctccggaagccattcagaacgcagtggtcaattacgcccaggggaaagttgaaggagaagaggggctggtggtgggcgcgagtctgtcggcattcgaagtcgccggtgccatcgctcgcgaaattcccggcatctacatcaaactctgccaggtcgcgtgcgtcgcggctggctcgccggctccggctccgggagatttcacttcggaatacgtcatgagcgcattcggccaggctaccatttccgttggtaacgttcgggtgactttcgtatgactctgcctgcgtacaattctgacatccaacaagctctgaaatggctccataaccaggcgcctggaatcaccggcctgatccagagaaaggcgcaatggtatgacagattcagccgccaattctgggccaactgggagcgcgacgttttccacttgaaaactgccaatccattcggactcatggtctggtgcataatcctcggcacgccgtcgaaaggctttggtctgtatccgaaaaacagctcttgggcgttcggtcggcttcgccagaacttcatctacagcggtgcgcaagtgccgccaccggccgacgcttcgccgggcggcaacttctacggcggcggcaacgccgaaatcctcaacctggacgagatcaggaaagtgctacagttgcgatatgtagcgctgatttcgaacggctcgattgcttatatcaatcgaatgttgaagtacatcttcaatgatgacgagccttgggatgaggcgactggcctgtacttctatctcatggacttgaccggcgaagatgggcctgtggagggccttaaggtatatcggaaggactgggaagggctggttttgctgtccagcactcccaggtccaaccatgttctggtatcgaccccctccagcagcgccgattggcctggagaaaacccatccgggaccggaagccctgtaactgtagaaacggcgtccgctacggccccggacggctccgctacggtgtgcaagcttactaagccggccgggagtaccgcttacgtctccgcgccgatagatgggccgctggggtccggtagcactgtaacgttctcgttcttcgcgaaagccggctccacccgtttcattgcaattcagtcggctgccgatttccccagtcgagccgatgccgttttcgacctggattccgggaacgtgatcagcgatcagatgttggacagcagcgtggtaagcgcccgaatgattcgtctggaaaatggctggtggcgttgcgttctcacgaccaagaccgtcagctcttcgttccgcgctgcttacgtcgctccggcagaaaccaacttcagctggattgattcgaattccagcgcggcgattgacgtgcttatctggggcgctcagatcgaactgggtgatactccaactggatacttggagactaccggggcgcccgtaaccatcaccgattatgttttgcagaacgcccagaccggaacagtcaagttcacacagccccttccgaccggagtagaagcgtgttggactggagactggaaaggcgggtctgcgaccgagccggccagattcgcagtaggggatgggactcaagatacattcaatctgtccagccctgcatacatcggcctacccactagtggggcgttcaagctagaatacagagttggtccggcgcttaatttgtcgccgcaattgatcaacctcatgaatgaccgggcggtcggtatcatgccgacttgcgccggttgcgatgtaaaagtcattcaggagtaatgacgtgatcacacccgaactgatacccagtccgtttgctgcgcagggcgacaaagacccgatcccgcagacctcttccactggttttgccaaccttcgcgacggctacacgccggactacgaaatcagtctggcgtcgaacaacccgcaagcaaaagcggtcgagcggaaaatccaaaaccagctcttcttcatagctacccagaacgcacaggcgtggcaacgtcagatggcgccgccgtggttccaaggcatgcctggaggctatgaaatgaacgccgaagtcgtgcgcatcggcaatgacggcatcatgcggcgctatcgctccatggccaactctaacgccagtgatcctctcagcagcaccacctgggaagagcaaccggcctggtccgtcatgcggtcaaatatcccgatgccggctggcggtcctggtctgtcttcgggcggcgaagtcatcaccaccggccgcaacttcaacgaattgctgaacggaacctgggaatttttctctgatgcaatcgtcgtggcctctcagaacgctccggtgtatccggcgtctgccggcgcggcagcaggaatgctggaggcgaaatcttgggtgtccgggtccaatacgttctgcgtccaacgctacactgatcgcgtcggaaacgtcgccgtgcgcggactcaatgccggggcctggaccaactggatgtacgctgtaaacgtcatggccctccaacacggccgtgtaacctatggaatcgcggccggtccggcgaatgcctacaccttgactctcgttccgcagatccaaggtggtttggtagatggcatgatccttcgggtcaagttcaacaccatgaacaccggcgctactaccatcaacgtctccggactcggcgccaaagccatcgtcggcgcggccaacttccctctcactggaggcgaacttggccaaggactcatcgctgagcttgtattcgacgcagcaggtgaccgctggagaatcctcgcaggcgcgccacgcatccaagttggcaacgccgatcaagattaccaggcccccagctggaaacaggtgaaggattacgtcgcgtcccaaaagctgactgaagtggactgggctgacgtcgtcaacaagccgaacgtcgctatccaagacactacgccgtggttcgccaatctggagttgtctgacgctcggcctttcatcgatttccacttcaacaacaaccgcgccaaagacttcgactatcgctttatctctgaagctgatgggtcgatggcgttctactctcgccaggggtcagctggtcctacccaggatatcctgttcagcaggtcgaatgttacattcctccagccgcgactggatgttgcgaaaaacctcgcgtacatcgcgaactctggtcccctttggcagaacacaactgccaatcagcctggttggaaattcaccttcgcacaaggtgtggacgccaacaacaacgcggttatcgcagtcaataccaccaatccggacggctcctatcgctcacagatcatgcgatgggactgggcgtccacgaacgtcatattcaacaatcgtccgctctttgccggtcaatacactccttgggattctggaaactttgatccctccaccaagttgactgtgaatgccacgaaccaaatcgccggcccgaccgggattcggaatgcaaacggcaacaccggcaacatgaacacatggggctccagttccacgacggcttcatacggaaacgctgctcttcaaatcttcgggaaaggtggtggcgagcctgccgcgctttatttcgacaactcccagacaggatggtatctggggatggacaaggatggacagctcaagcgggccggctggtcgctcggcaataacgcctacgtgattaccgacgaatccaacattcgtttccacgtgaattccatggctggcactcctgtttggggcggaaacgaattctgggggccgtggaactttaatccgaacaccaagctgaccatcaaagccggcacccaggaaactagcagcactgcgatattcagcggaactatgccattcgctccaatcgcatcgctgtccgattattctcaggcccctttgacggtttacaacgcgccaaccggtccgtctgcaaaaccggccgtcatcgcgttcattcgtcctggcaactggggcgcgttcttcggcatcgataccgacaacaagctgaaatggggcggcggatcgctcggcaacagttccagggaaatcgccgattccagcaacatcatgaatctttgggcggccaacccgaccgcgccgtcctggaacggccaaaccgtttggcgatccggaaactttgatccggcgacgaaagtggatttgaacgccgcgaacgccaccaacggcaacatggtcttcaaccgcatttctggaactggtagcggcatagcttcgtcaggccgagttggcgccatcaacctgcagaatggggcgcattcggggcaagcggcagcagtcactttcgagcggggcggcagtatcttcgtcaacttcggcttggataccgacaacgttctcaaagtaggtggcggaaacctgggggcaaatgcctatccggtcatccacgccgggaactacaataactacatcaaccaggcgctggttcaggtgggtcttggcggagtcggttcctatggcatctttgcggttctggacaatgccgctccaaccgcgaccgttcaaccgggagtggttgtggacggttccattctcatctactcgtcttgcgccgcaaactacaatagcggtcaaaggcctgccggaacttggcgctgcatgggatatgtagtcaaccgggatgccaacactcctgactccgcgacccttttccagcgagtgacgtaaaaatgaaatggacgcggatcagaaaccctcgttggctggatgaaacaaacatccacgccatggtgactttcgatgggatcggggaagttccttttaccgccaatccgcacgacgtggaggcccacggaagggccatccacgctgcgatcctatccggggcgcacggacctatcgccccggtcgatgcgaagcgggagcaggccttgcaggacgctatacgggccagggaaaagcgggctatccttcgtgatacccgctggcccatagatcgtcacgacgagcagaggcggctgggtatcgaaaccacggacggacctgggttgatagcagcccttgttcactggaggcagcagattcgcgattggaatagcggggatcggccgcgacttcccatggctctgaaaactatgttcaaaaatcaggagtattgatgaaaatcacaaaggatattcttatcaccggaaccgggtgcaccacggatcgggcgatcaagtggctggatgacgtccaggcggccatggataaattccacatcgagtcgccgcgagccattgcggcctacctagccaacatcggcgtcgagtccggtggactggtgagtctggtggagaatctcaactacagcgcccaaggattggccaacacatggccgcgccggtacgcagtagacccgcgagtccgcccgtatgtcccgaatgctctggcgaatcgtctggcccgaaacccggttgccatcgccaacaatgtgtacgcggatcgcatgggcaatggatgcgagcaggatggcgatggttggaagtatcgcgggcgcggcttaatccagctgaccgggaagtcgaactattctctgttcgccgaagactccggcatggacgttctggagaagccggagcttctggaaactccggccggcgcgtcgatgtcttcggcctggttcttctggcgcaatcgctgcatccccatggcggaatccaacaacttctccatggtcgtgaaaaccatcaacggcgccgcgccgaacgatgcgaaccatggccagctccggatcaaccgttatatgaagaccatcgccgcgatcaatcaaggctcctgatattcgcccaaaagaaaaggccgcttattcagcggcctttttgctttccggctttgcctcttcaaccatcttgacttcaaccggcgcggcggactcttcctgagtgaccgaatccacatagttccctagtgaactaagaacgccgattaacagcgctcttaccaccttgtccttgactgtctcgcctatgatcttggtcagaacggatattaactcttcccggagtctggggctgattcttggccgaaagcgcttgcgatgctctttgcgtttcatgtttagtcctctgtctgcggtcttctcctcaccccgataatggcttggggatgcgctgtgttaatcggaaggttcgggcgctattataactcgtcgaaaatgctcgcgcttaactgtttaacgatacgcaccgcgatattaaatcgccttctttctggccaaggaactctggcggccgggtccggtctaaggcctaatttgtcgacattaaaacgagaaaacccggatcgcctgtagggcaatgcgtccgggtttatttctatctagtgtacgctaggatcagtgacttccgccccacccgtccagccagcaatcgaagacggcgtgcctcggcttgtccttggcgccatgggagaagtgcttgaaccggataacctggcccttgagatactccctgtcattccagcggcgctgtttctcgtcgtgggtcaggctggaggccgacacgttgaaggtgactccaggccacagacgttcgttgcggcagacgaacgcaccgaccattccggacggcgacaggttttctgcgtggctggagcgggccgtgtggccaagttcattgatgaaagcttcattgttgttgtgcatcaactcttccacgtcgatgatctcagcttcatcgtagtcgtatcgcttgactttcacacagtacccttccttggcagtcgagcgaccgaacttgtacagtccatcagcgcgcttgcccatggaaccttcgaatcccagcattgtgtggcggcgctcgacttcgctgaactgttcgatggaagtcaccagttcctgctcgaccaggtgaatcctctcatagccgaggcagtgacgaaggaagttcacgcgctcggccgccctggctaggcgatcttcggtcggtgcgcgaggatcggtgaaatcatcgaacacatgaaaagaccagtccggctcaccgctgtggcggcgaagatcgccggacgacttctggaaaactttcgggtcgctgatgtcgccgcagaccagctcgccgtccaggccgttgaacagtttatcgctgaggtattcgtagatagattgattgttctgccgcttgagttgacgagtcagcgcctcgccttcgaatacgaagcagcgaaatccatcgatcttcggcgagaaatacatcggcagttggccttccagcagcttcgggtcaaaattcgatgcgagcatgggtttcatacagttctccagaaaagaagcccggcgaaccgggctaaatggcggtaagccggctcagatggtttcgttggcgtggttcagttcggccatgatcgacgcatagcgctcgtccgactccttgatgaacacgccgtcgtacatgacgcctttgcgatccttgatggtgtcgtaggccgcagcgtagcaggcgagcatggtagtgtcgtgctcttccgtcacatcgaacagagtcatgacggccaagaccaggctcttgatggctaatccatgatttccgcgtgccagcgcgccggccagatgtccgaggtgctgcaaatcgtcgcagtaggtgggatgaacttcgacagtctcgctgaagaccgatagatgatcgaacagattttcaccgagttgcgcggccatgatcgtggcaaccaccattacgtcgccgatgccgtctttcacctcgactggtttgttataaacccaggcttcgcaaacttctgcgaactcttcgaccaacttcaggaattgatccttggccgaagagcctttgatcaggttccggtcggaaccccatttaacaaccaggtcgtgaagttcgcgactcatgatttgttcgatattcattctttcgattccttttggatttgggatttgactgcgttgattatggacgccgtgctctggcgcgatccatccttggtggtgccgaagtagaaggccattaccgacttcagctcggcgaaccaatagccgatgatggtgccgatggcgaccgaggatgtcgggtccatcagagcctcgcggccgaatgtgaagattgcgatgatgatgagaatggagcctgtcagaagagcgaatgtgatcgccgggcgaacgaaatcgttctgctgcgccgcaagcctcctcgcagaatccctgtcggccgcctctgcggcgaactggctaagctcggcctggagctggttctgctcagactgaaggcgattttgttcggcttgaatcgcaagctcctggagacgaacgcgctcggcgctctggagttcggcgagacgcgctagagcttccggattcgcgtctagagcgctagcgaccgaggctgggtcggccttcgaccccagcgccgtagcgacgatagcgccaacggcggcgcctgcaggcccacccaggagcgaccccagagccggggcagccgcgccgatcttactacctatgtctttccagtccatttcgactcctcaaaagaaaggcgccattacagcgcctttctccggccggtgatttagaactcttcggcttcggtcgcatcgccgacgccaccggcgtcactgcgaggctgttcctgcttgctgtagtccaccttcacctcgccgccgacgaacgacttgtacaggtcggccgcagccttgaagtgatccgggttcttcaccaggccttccagctcgaactggacgccggaccagctacccttgtcgttcgacatgcctacggtggtcatgcggaccaggttggcgaaagtcggcggggtgcgcaggccctgcggggtctgaacctttttctgggacagcgcggtcatgagcttcttcgaggccttgatctgcgaagacgacagggagatcagagcctggccgaaatcgccggtgtccggatcgatgacgatgacgtaatgaccacgggtgtcggcgaagtagtcagacttcttgtcgctgaccgaaccgtcttcgttcggcgcgtacaggcgtccttcgacttccttcaccttggtcgggtctttcatcatttccttgaagtcttcgacgctgatggcgcccttgaaaccgccctcggcctcgcgacctgcccagcggatgaactcgcggcggtacgcggccggaatgatcagcaggccggtcttgccgtcgtaaatcttgccggtgacggtgttcaggaacatgccggccttcgcgccttcgatgtacttcgggtcatcttcatcgacctggggagacatcttctgcagaacctggatgaaggggatggcataggactcggcatcggcgccttcgaagcctgcgccgtcatacgatcccaaatccatgaagtcgggaacttcggtagtcgcgacggcgccgccaccggtggcaactgctacggccttggtttcttcggttgcttcggaagtttcggttttcttaccagccatgttaggctccttgtttgtcgaatttcagttatcgctaactgtgggtttataataacggaagttgcaactaagtaaagcaaattacatatcaagatttgctctttttcaccttcggtttcgtgatcttggcctctttgtattcgtgtacgccgatgaaatctggcagctcttcgcccttctccaggtactcgcgaccgaacgcctggagggtctggtaatggacatcgcggttgatggtggcgtcatagccggcttcgatgatggcctcggccgccttcttcgcatcttccatttcgccgcgaccgaattcggccagaaccttggtcttgatgatgccgtcgttgtcggtgtcttccagccacttccagaacttcgatttgttctcttccttgacggaaatgatggccttcggctctacttttaccgtgcgaccgtccgccagagtagtggtcttctgaccaagctcttccaacagctccggaatggtgttacgcttgagggtcttcagctcctcttccttttcggccagcgccttttgaagatcgaggatttcgccgtccagctgcgaggccttgtccaccaagttcagcagtcgatggccgatgtcggtggcttcaaccgccatttcatccatgacgccaaaatagtcgatttcgcccggcgcgttctctttcaagtattccgggatttcaagctcttgctctttcatgtccgcctccaacttagtgatgttcccttacttgaaccaagtattgagtagatattatgccgcatcttccttgatacggctactgatttacatattaaatttcgtcgcgagtgctaacgtcagcctcaaacacgccatcaacgacataacttgccaggttgcgtttccactccaagctgacctggattttctcgtcgatggaatccagacagatcaggtcgaagtacagaaccgagttgacggtgccgattcgatgatttcggtcttcggactgcatccgcagctcgttgtcttcgtcggtcgtgtagtagatggccacgtctgcggcggtgagcgtgatcccgatccctgctgcggccgggttgcccaggaacacctggacgcgcttggcctggaaatcgtcgatcaatttttcccgctcggcctctttggtctcgccgtagtatgtgccaaacgaaattccttgggcctccagatacgccttgatctggtcgatttcctgaatgcgcatggcccagatgatgatggagcgctccgggtcttcctccagcagaccctccagaagatcagtaaacacggcgaatcgcgggttgtcttcgggcggcaggatcaccggctcgccatagacgttgatatagccggatgcaacttgcttgagcttcgaacgcgctgccgcagcatcgaaagatacgtccagcatgaagtcttcgttcttgagaacgaagtggtagtcttcttccactcgctgataaaccttcctttgctcaggcgacatttcgaaatatatgcgcttgtaaaccttttctggcaggaatggtaatgcctctttcttcgtgacccggaagctgtgcggctcgatcagggaccgcagtttgtcgagatttcggaatactggtcgtccaagatcgtctttctcgacgagctgaggggggactgtactcttcccatccaatttgcgcatgatggcgaccattcgcggatcgtcgctgggaaccagaacggaaaattcagccacgaacgcccgataggatttcgtgccaagaatgccatcgcgtaggaattgaaactgcatgaacaagtccgtaggcgctcgcgtcagaggcgtgccagaaagtattcgacgtgccacggccttctcgcccagctttacgatctttttcgcgcgttttgcttgtgggtttttgatcctcgtggattcgtcaacaatcgcgcacactctgaacgtcttgaggaatcgctcgacttcgtcatagccagactgatggttgatggcatcgacgttgatggcaaagacccggagaactttctcatcggcgaacgtctcggcatacagacgatccaaacgcgccctggcctttttggaagtcggtctgccgcgccaatccacgcacagagtcttgactgcgacgtgagtaggaatttcgcgcagaatccagttagtatgcacgcctttgggggcgacgatgagcagcgcgtcaacccttccttgcaggaagagcctaactgagtctgccaaagtagtccatgtcttcccggtgccctgttccatcaggtaggcgaaatttcttttgtttagggaagctgccagggcattgaactggtgctgcatagcctcggtcttcatacccttgactggaaaggttttggctttcatttgttctccagatctgcgaggaattggatgatattgtccagtccttctgcatgactcgcgacttccaccaggtcgcggctgttaagatcgaacagatcgagcatgggattcagaagcagccaatcggttccgatttttgccaggacgaagccgcgaccaccccagccaatccgctcccgaaggaaagggatttgcccaggctcgaaacatcttgccattgggcaggtggaggcgcgtttcggccactcctccaacgccttgaactcgacccagaactggacacctcgacgattcaggcaaatcgaatcggacataccagaccgccgcgtctccagaaagtcgatcaggattcggccgagcgagcgctgcttaaacgcattcgccgctttcgtctcgcgatcattcatcgccttcgccctctttggaaactttcttagtttgctcttccagtttggccttctcgcgctcggtcaatatccgtttgatggccttcacgatgaacatgtcgatgccgctgagcttccagcctttgatcaggaaccaagagccggtcggcgtcccttcggcgatctgctttccgtatcgcagatatttctcaggcctgatacggaatcggatttgttgatcaaccgaatcatccacacacatgatgtcgaggaactgcgactggcccttgtacaccgggtttttcccttggtcagccctcttcttctggcgaatcggttcgttctcatctgacagaactttcttcaccatcttgacaataaccaggccgtcgtcgccatcgcggatatcccgaatgttctgaatggggtttccggaagttactccaaccagctccggattgtcataagcatgaccccagagcgtgtgagcttcgttcaagtctgcgaattgaacttcagaattcgacagactcgcggcgactttctcccaatcctgaagcgtcttcaggtgggagccggccagctccttatattgggccttcagctctttcagatcggcctttagctccttcagatcggccttcaacagtttctccagttctttgtctcggctgattttcgccgaaagaatctgggcttccagtgctgctacatcagcctcctttacctccacatcctgcgccgatatcgggcaattggccagggcgatccttgcggccttgacttcctcgcgaaggcgcaggaacctctcggccttcgccgggccgaagcctttggcgttcatgatgccgccgatcaggcgcccgtccgccaccacccagttgagttcggaatgctccgggtccagggccgtatattctacgccttctttggccaattcgcgaaggatagacacagtttgctggtcgtccttcgccgcccgaaggcacgcggccgcgtattccaggcgatgataccgcttcatgtagcaggtccagtacgtcaccacagcgtagctgaccgagtgggagcggttgaatccccaggctccgaaagtcaccatttcctgccacacacggtgagcatcgtccggggcgacgcctatggtcttggcgccctcgatgaacaattcccggcgcttgttgaagaactcttcgccctttcgcgcagacatggccttccggattgccgatgtctgctcccagtcgaactgtccgatgtccttgacgatggacatgatctgttcctgatataggaagacgccgtacgtccctgacagatattgctcgacctgcggaatggtataggtcacaggctcgcggccggccacgcgctcgatatacttggtggccataccagaagacaacggacccggacgggcgagcgccgtgatatggtcgatgttttcgaacgcggtgatattgatcgcgtttgcgaccgaacgaactgcctgcccttcgaactggaaaatgccggacattttgtcttcgttgagaacatccaggaccgccttgtcgttcaaaggcaagtcgtacaactcctgcgcagtcacacagttcgcgtcctggatgacgcccagagttcgaaggccgagcgcatcgatcttgaggagattcaaatattccgaatccggcttatcgagctgcgcgacgccttcagaagttaccgtacagaagtcgataacttcatcgttgcagaccaggatgcctgccgcgtgtacgccagagtgggatgggtgaatttcgaggtcgcccatgcaggcggacgcgatctcatacttttcgcggaagtcgcggccgggctgagttttctcgaaagtgtcctccaatccttttccatatcgttcgtccgccgacgtatattcaatgatcgagtttttgatgttgtctgtatcgtggaaggggatgccgaagcgctttccgacgtgagcgataaccgacgcggccttgagcgtgttgatgttgcccaacttcaccacgttccaagtgccatacttctgctggagatattcgaacactagatagcgatgggtatcggcgaagtcgatatctatatcgggaagatcggaccgggaaatgtcgataaagcgctggaagagaaggcgatgagggagcgggtcaacctcggtaatgccaaggagatagcagaccaaagagccggccgaagagccgcgagctgggccgaccagcatatgcttcttggcgaacgcgaccagatctgccacgaccaggaagtagctgtcgaaatctttcagctgaatctgcttgatctcttcttggaatcgatcctcatactcctgggtccattccttgatgtggccgcgactgagacggtaggcttgcccctcgcgagccagcgcgacgatatccccatccaggtggatcataggcgccttcgccagtttcacatccgccaattgttcgactaccgcacgagtattggcggcggcggcatcgaactcttcgcgagtcatgatgtggcgtaaacggctccacaactcctcttcggtggcgatgtggcgaaggccgaccgattcccgcaccttccaggccgacgcgaaatcagcatggtcgatggacggcatgtcgttgtaagaggtaattaccaccggctttccgaatgccctggccgtctccatagcgccgtgcgcggcgaccatcgacgcgggattgatgtcaatgtagtcgattccggccagatccagatgggcataggcctcgccagcgaatttgatgacgccgtcagcttcctggaattcttgcggagtcaatccttgattctggaccgacttggaagtcaagcggtagaacttctttgtgtccttggcgagcacccaggctttgagcttcagctctttctcgccatcgtcggcgcatttgatcgggatttccatgccgaatccgcgaggcagttctgccttggtagcggcttgttcccaacggacgtggccccatgttccatcatcgacgatggcgacgaatggggattcgatctctttggcgcgctcgatgatctccgggaatcgaccatatgcggcgccgtaggagtaaccagagcgaacgcggagctgagggaaagacatcatgcggcctccattgcttgatacgcccgatacactcccatgcgcttgcagacttcgtggagcagccgcacgtcgtcgagcgcccggtgtttctgtacatatgggccgcagtagtgctcataaagatgttgcagccgcatgcggtggccgaacaacggcgccgactcttccacagtacagatatcgagcgatgggaaattgacttcgtccaggccgaacttgccgcgagccagatcgcaggtcagcatgaacttatcgaatggcaggttgtgggcaatattcgcgtcggctctggaaaagaagtcgcgaactttctggcgctgatcgaggaaagatgggtgcttgaccaggtcttcgttcttcaacccggtgatcttggtgatgatttcctcgataacgattccaggattgcagatgaactctacttcatccaaaatcttttcgccatcagttatcacgccggcgaattcgatgattctcggctgctttctcagactcaccctttggtggaacgggagtcctgtggtctcagtatcccatacagcgaatatcatgtttgttccctcttatgtcgaaaggccggctgctttcgcgaccggcctgaggagtataccgcgacggctgaagatttacgccttctgtccgtctttcggcgtgatgcggccggagcgcatggtggcgtgaacaaacgccgaatagttgatcgagtccaaggccgaatcggcatccttgaacccgctattcgccaggcgagtgagtttacccaccatgtgcatcacgaacagggcgagtcgatgatcatcggcggtcttcgccaccaggccgttcgggaagaggatttccatgatctttccgtacatcagatcattgcgaccataggtgctctggcgggcgcggaagacttctgctgcggcgtacagattgttgagaacatcttccgcgaaatcatctggatgggaatcatcttcgcccggccagacggattccatggcgaacggcgcggcgtcttcggtcgggtcttcggactgagccgtttcagcgagcggagacggggctttcgcaaacgcctcgtcgagggtaggggcggagttcggggcggccgggaacggctcgcctgccatgtcgttgggcgcgctatcggggtcgctatcggccgcgacggcgaagaacggcgcatcgcaaccttccaggttcaggatgtaggagtcgatccccaggctattgtaggcatcgatgatgtcctggcgatcatcgaacgccgcgacgatcttggtgacgccttcgattttcttcaggatgtcgagcgcgactgcccgcttgaactgaggcgccggctcggtgttaccatacggccgcatgatgagttcatactcgcgatgttcggcgatgccgagttcgcggtggagctttgccctggtctggaaaaagtggttgtcggttcggccggtgacgaagaaaatcatgaggtcggcgtcgatggcattcctgatgcgacctacagcgtgcgggttgagagtgtccttgtcgagacgagaatgatactcgtcccattgccgttccaaggcgaagctcttgcggtggctatcgtcgaatacgcagccgtccaggtcgaagatgatgatgccattctttggtttgcgttccatattcagatttccttactggttgctttctgggtgacggttttctcgatgaacgtcccatcagaagtgaggcggaaaacttcgccattctggatgaaatcgaacgattgcacgttcatcgtgatgcgaatggattcgctgccgttggtcacttcgacttgtgcgatgtcgccaactttctcgacaatgatcttcatgttacatggacttcccattgacggccacagggttagcctcttgtttttccgatccccagaaatcgcggcgcagttcttcctgctcggccgagcgatccatccaggggcgatagaacttgcactggtagataggttccaacggaacatcaatcacaggaatctgacctggctttgtctccagagcggccatgaaccggtcataggatttctgctggatttcctcttcattcatcaccttcgacccatagcgcgggaaggcgcaggagccggtggcgacgcagtgcggctggagcaggctgtcgaacataggatagacttccagaaccagccggcgcatttcgcggaatacttcctgatattcaccctgggtccgaacgcacaggcgaaccttcgccatgtcgctgagagtccgcagattgaacttggccgcgatcttcgtttccatgttggaagggatgatggcacgagcgtcctggagcgacgcgccggcctccagaagcttctggtagctggtttgcgcgtcggcaatggcgtcatgccacagacggttcagctcttcgcggacatggtaggtcgggtcaggctcgccatttaccgtagccggttcgtcgaattcccagcggaaggcttccggctgaacgacggcgctgatttccagagcgcgactggtttcctgctggtaagccccggtacgagtccgaacgagttgatgggtgaagttcttgctgacaccctcgatctggaaaatgaagtccacgaactcgaacggcgagcggatggtgtccagcatgtacttccagtggtcaagcttttcggcctcggtcatggtcgccgggtcttggccgcgcatgcgagtggatttcgtccccaggagaagttcccaggcgttctgggtgtaactgatcagagaaattttcatcagaagtcttccggaattggcgtgaagtggaatttttcggtgagagccagggccaggtcttgggcttgctctttacgaaggccatactgctctatctcttccttgagcagttcgcaggcctccagacgcgactcatactcttcagcctcctgaacggatgagaagacggttccatcagaggttcggtacacaagttcaatcgacatggtgacctcagtagcagcggatgatttcggcgcggatatcgcgacggtccaggtagtgctcacgaatcttgtcgcgggcacgctcagcctcttcgcggctgccgaacgacaggttgaacgacgtgaaaggcttatcgtccagttcagcgccggtctgatacaggatgcctaccagaacgaaagacggcgcggtcttcggctgctggtcggcttgcatttcgagttcgaggaaggacataggaacctcttcaggatgatctggtgcgtaaattaatagcgctcctgctgagcagctacggtttccggctcgtagatgagcatgtcaacgatttccgggcactggcctttcacccagtcgatggccgcgaccagtgtggtggaagcggagaaagagaaagtgcggtaagactcatggatgtacggcgaccccatggaatcgcgctcggtcgtgcgcgaaatgactgctttgatattaacgatccggcccatcttcggcctccactttagcgattatatcggacaggcttaacttctcgccattcaggaaataactggcgcgaaacttcctgtcgccctctggcccgacgattctggccgttatggtgagactcccgccgccaagagcatcggtgtcccggaagaaagtcagcagcgcccgcttgagcgctgcttcgcgaggatcgacggccattaacctaccacattccagccgtgctgagcgcaccacacggcaccggtccctgcaggaagactattcagaaggaacacaggagtcaggcggccgtcctcggtcatatggatgaagtagcgggcgccttcaccgagccattcggccttggcgatagcgcgttcgagattggccttggtggcgtaggttttggtgtggttcttgtcggtggagaaggttacttcgcgggccatttgtcgattccttttggttgaagggtttcgcgtttcgatgagggaatattacgcccacctgatccagaagtaaagcacttttgtaaattacttcacgaacatctgcttggccttctgataagacgaagaagtcatcaggcgctcgatgacgtccatgtccgaaaccagatcatccagaaggacattgcgccaggtagcgaaccggccgagcgagaagatgccagcctcatgggtgagattccagatcatggattcgcgctcgtcgcggccgagcggaacgattttgcctttggtctggatggtcggctcgccgtcctcgatgagatgccttttcctgatgccgaaggccgcgcaaacgtaatccatatcccagtcgctgtcccattcgatggtttcgattttaccatctaaagtctccactatccccttagtgatggattcgacgatcagagtatcaccggtgatggacgctcgaaacgttcccactttaggaccagggaaatacacggtctggaagacatcacaggggatggaaagcttgtatcgactcacgatgatggaggttccttcaccgaatgacgggtcgattcccaggtccagccctgccgcagccagattggcgcggaacggcgcggtgctgatgatattcacgtggtcatcttgccggcgaagatactggaagaaagatgcgtcgaaaggacggctccaagtgatacgattcgcaagcttagccaccagctgctcatagtagtcggccggtgcgatccaacgcttttcagtcgccagattccagatggaccggtccgacaggccgcccgttactttcctggagtacatgttgcagtggtcgatgcgcggctgggaaatgaactcgccgtcgatgtagatagctttgtgtacagtgacttcgcggaacgggataccggtgagttggccaattactggcgagcggaatcgcaagagtgcgttgtgacgctccttgttctccggcgtcgccgcgtcgatgatttgggcttgaggaaagcgatgcgcggcgatcagtccggcgagtccagcacctacgatgatgactttctgatcaggaatcatgatgtgttccttctgagtgtacaaaacttgagaggataaaaaagggacccattttcatgagtcccttgaagagctagacgattcaggctcagaggagcggcggcttactcctcctcaccttcggaaccatcggcgccctgatcatcgccgtcgtgctcctggccttcgtcatcggccttctcgtcatcgccctggccagcttcgtcttccttcgaagcgatggcaaccagatcgacccagcccatgacttccagcttgctcaggtagctgcgaaccgaggctccatacagcaggtgcgccactttctcgccaaaggcttcgatttctacaggctcaccgacggtgcagttctcgttgatgtaggcaaacaccttgccgcgaatcgaaatggcctgcggggtgccatggccgtcgccggtcgggatgaagtgagtggcgcgagggcgacgcgagccattggacttcagttcttcgcggcgggcttcggccttcgcgcggcgctcttcctgctcttccttgcggcgctgcttctcggcttcgcgctcggccttcttctcctcggccaggcgcttgcgttcttcttcgcgagcgactttctgggcttcctgggcagccttcttctcttcggccttcttggcgcgctcggcttccttctctgccttcttctgctcgcgctcggcttctttggccttcgccttctcggcctgctcggcttccttcgccttagccttttcagcacgctcggcttccttggctgcggccttttccttcgccttttcggcgcgctcggcttctttcttctcgcgctcggccttgcgcttctcttcgcgctcggctttcttctgttcggcttcctgggccttggcctcggccttctcggcgcgctcgcgctctttacgttgacgctcggcggccttctcggctttgcgcagggctgcggcttgttccttggtcagctcttcgccttgggtctgttcgttctggtccatgttcttactccgggaatgtttgaaaggatggcttattggcctgtgagaggattatctctaaactaattgaagaagggaatacctttcgcctgaacttctctaaatatttttctttcgggaaagtccagactccagggaacttatttatgttcgcgaagtttttaactcttacgcaaaaacaacaagtattcaattgcgcgagttatgccagtatacatcaactggctgtaaggaattgaaggcaagttttcttccaacattgcgacccgcttccattccgatccctgcgacttgtggaacgtcatcgcccagccgaagtcgaatccgccaatggccttctgtgcctccagccgcacatcttcctcaaccgaaaagctcagaggattgaacttcacccagcgctcatagttcgtgccgataatgcgaactttggcaaacagcatttcatccggctcgtcatcatcttcttgaccttcggggaccggcttgaagtccagcagaattgcttgctcgccgttcatgatgccatattcgtgctggttcccggtgcacaccagcttctcgccgatttccggttgtacacccttgtagccgaggatgcggcgcgccctggcgttcaaacggcggcgagtattgttgtaggcgcaaaggatcacgccatcatcgtccaagaacgtccgcatttcgtcgtccgacatgtcgaatccggcccgtaccagaatgtcgtcatactcgcggcagggtaggcgcttgccctggcggacgaacatcgacgctcgaacgatattgccggcgttgcgctcgatttcggtcatgatggtgtcacagctgttctcatggaaaatctggacgccgcgcacaggaggaacttggccaaagtcaccaatctccagaaccggaattcggtgcgacagcaagcgctcttcatcccactcgccgatcatggacgactcgtcgagcacgaccaacttcggcttctcgtcgagcgagtctttgttggcaaacatgatttcgccgtcttcatcttcgccaatcggccgatagatgaagctgtggagggtccgggcattggtgcaacccttctcgcgaagccgcgctgctgctttcccggttggcgcgacgaagaccgtccagtccatcgagcagcaaagttcggcgatgatcttcgcgatggaagtcttaccagttccggcgaaaccagcgagtcgatagacctggcggcggtgcgctcgatcacaccaaccgcgataccagtccacaacggaattgatcgcgtcgatctgctgactgtttggtcgaaagccgaatcgctcttcgatctgatcgacggtgaagttagatgctgacatatttgcgttctccaacgctaggtttaattgaatcgaggctcagtttaagcacgccgtccacagaccagccagtatcacgacgatacttgcggccttgcggatcgacatagaagttcttcgtgcgccgcagcagaacataatgccaagcagctccaagcgcgtggacccttcctttatacgggaaagccttcgcctgctctgcggcctctttggccccagggagccagcggacggtcgaaaggaccaggaccgcacccttaatagcctgggaagcggcgcggccgtcctgtgggctatagcgatgtctatcgaagtctacccagtggtggttgccgcgccggagcttgaccgttcgggatcgcccctcgaacaccaccgtgccttcatgagtaaaaatatgttccgccatcgaatgttcctttataacgtacagttatgctttacctctgcgcaggaagagtatactatcagctgactcgccaaagcgagcgaatttaatccaactttacttcggcaggaaagtggccgatactagcgccgccgcctgtactgccctccaaaacagaggatacattaaatgcaagaatgcaagatttcccgcgaccaactcccggtcggtaatccgaatcccaatgtcgacaagacccgcgacccgaacctgaagcccggcttccttcgccgaagccgcgagctggacccggcgctggccgttcgcattcgtcgcgagctgatccacgccgaagcatccgacttggccaaggccggatgggtcaattcacagtccagcctttatggatcgaaagccttcccgcgccattccgtcgttcgcgtgaccggagttccggaagatggagctttcatcggcatgctgatcggcttcatcgagcatcgcgagcatggcgaatgggcggtcatggaagccggaacgaaagaaggcggcgccgtcatcatcccggtcgatcacatcatgcgagcgtcattcgccgaagccgaagagttcgccgaaaagtgggagcggaacttgggatggcgcctcctgcgccagctccgcgagtgcggcgccctggccgggactgaagacgagttcctgcggcggatcatcaatcgatacgttcgtgatcgcacgatcctcgaccaccacaaagtcggcgctgacaaaatctacactgatgcagtgctcaaaagcatcggcgaaacatggccgaagattccttcggggaaattcgtcggacaccgagtcgcgcaaatcctgatcgaccacaagctaggtcgagcgggaaccattctgaatgacctggtggacttcctggagaagttcgcggccgggcgcgataaagttctcaacatcgccatctgtaattgaggtgaatgatatggaagatttgggaaagcccagtattccggagttcgagaagatcgacgccaaaaaactttatgaggctctggagacgattgcggagctggagaagaagtgggacgaatccgaaaagcgcacacgcgatctggcagaagtggaacggccagaggtagtcggctatcgcagcgcggcttcttgcatggtctatgaaaaggactatggactgcagaatcctgagccgatgatgcttgtctcccagcacgaccgcatagtcggggagctgctgactgcattagcctcgatgactgaggcgcgcaatcgctacaacaacctatggaattgcgctggtaaccgcctagctttggcgcaagttgaaatccgcaaagtaacatccgagcgctacgcagccctggccaggatcgctgagctggaaaaggaattggccgaatccgaaaagcgcgggagcgaactggccgcgagctattgcgatggcgtgatcggcgatgaacacggccatccttattgtcgttataaagtggaacgcgacgccgccctggccagggtcgcagaactggagaagccagaccctgactacacacaacacccgcagatcgtaggctacgtccgcaagaaagagttggagcctttgttggacccgtgtcaacctgatggcggccacatttacataggtttggaccatccggcgctctgggcagaggagccgccgtatgaatttcttactcccctctacacggcccctgtagcccaaactcaacccagcgtgccggaggggtggaagctcgtaccgatggacccgacatcgcagatgacctctgtcggtcagtccctgcgttatgacgcggtaaacagcatcggcgagatttaccggcaaatgctcgccgtagctccctcacccatcgatccggccgcgcatcctcagccgtgccagcaaccacaggcccatcctgcccgctgcgggtgcgagcggtgagtgccaagtaaggagtttatgtaatggaacagcagaaaccttcggaagtagatggagccatcgtcatgaccgatctcgatattcgcattcttcgaaaggcgaagccagaagcgcaggacgagtgcgccgtgtccatgttcgcaacggcgatccgccagaaactgcagcgctcccgcgataaaggccgaggcggctggatcgactgcgacgaagatgtcctgatcaacggattcgccgaacatgcgctgaaggggaatgagaacaatctcctggacctggcgacgtttctcatgttcatgtgggtgcgcggcatcgacgatgcgaagattcccccggcgctcgaaaaggcgcggcagcacaagatcatggaagcatggagccgaattcatgaagatggtctagactccgccagaaaggcgagttctgctcgacaattcgttggagtgccgcgccgcaaggggcgcccggatcgactcgcatgaagccgcacgaaataagactggcacaagccgaagagttcctgcgcgaacttggccgagggattccggacgacgaacgggtgatggtcggctacgctgaagaggccacagtccagaccgacgagaacggccgcaagctcaatgccggctggtggcctgtgccctggaaggaagggaaatacatcaactccagatccaacgcctacgcttgtatctcgtcatccatcaagacgcccaacccgaagaccggccagatgcgatactggcgcggcgaagcctctttcggccacggcctggcgttgatggtcgatgacatcggctcaggcaaagggtccaagggcgacttcgaccgcgacgagttccgagaacgactggagccgaccgcgattgtggagacttcgccgaacaactaccagttctggtatttcttcaaagagccgatgtcccacatgctccagttcaaggcgctgctctattcgttcgtggaccaggtgctaaagaaaggcggcgacaacacagtcaaggacgtcagccgttacggccggatgccattcggcttcaacaacaagcgcgggaaagatggcaagttcaaatatgccgacgaaaacggcaagcccgaactcgtgcgcctgtacagcgccgactattccaagcgctactcgccggaagagatcgcccaggcattcggcgtccgcatcatcatgccacagatgaagaaggtggagataaaccgcgacgattgggtgtatgaccaagtatggctgaagtatgccgagcacatctgcacgaaatacaagatgggcgaagcggcaggcggccaggtccagcagaatatgtccggcaaataccgcatccgctgtccctggggcgacgagcacaccaacggcgatcctttcggcgcatactttcgcggaccgatacctggcgccgagcacgaatatgtgttcggttgcgggcacgatacttgccgcaaagagcatcgacggacgtgggcggccttcactgatgaagtcgtcctgccgtatattgtcgaacaacttgaacgcatcaaccgccgtcacatcggcgaggagtagtaactatgcaaaatgatcctggaattctgattaccgccatcggctcatcgcttctcggccttctcgtcttcttcgaaggcctgaatggatggaaaataccagtagcgaactttctcgcgtcgctcttgtgcttcttcgtcggcctttctgctttaacgtgctggttcgtcttggcgtttgacgtgttttagtcgacgaacggtccggaaattttcggatgggacggaacttattagctctgccggtttaggtaggagataatagccgtccctttcgcctcaatatgtagaggcagtgttatatccgatcatgtaaagcagaaggcggcaaacctaacatgattatcgacgacgataacattcttgatgatgacgaatcggggtccagtgagttcgatctcacacagatagaagatgctggaatggaccctttgatgaccgccgcaagtaaagcggccgacgatgcgattgcgaggaatgagacttaccgagcgcaaaaggcagcaaagtatgcagaggcgtatgcggaaccagatttgaagaagcgagcgcgattgttgatgctcgatcaggcctttgatcttccggtcagccggctggtgaaaggaccgttcgacgacttcatcaccaagtacagctcgacttcagacagcaactacctcgcggtctatgatacgttgttctgtaagggcgacggaactgtcccacacccgcacttcgacgagtttcgcggccggctggtggaccaccgaggcgtggcgttcaacaacaaaaccctcgaccccattgacctgatgggcgccctcgcggctgcggccttggacgatccatcgatcaagaagacgattgagacttgctgcgtgtgggcgcgtcgatatcgccgcaactctttgatcgagacgtttgagaagaagataccggagtgggatggcgaagagcggattgacacgttactgatcgacttgttcaagccgttcgacaccgagcttaaccggatggtgagcaagtatttctggctgagcttgtactgccgcatcaactatcctggaatctcggcaccgatttcgttggcgttgattggtgggcaggatgcggggaagtcatatttcggcttgctgatctgtaaggaactgtccggtgggcgcgatctggctccagttcagctcgacctgagccgacatgaccagacgccgttcctgcgcaacatcaccggcaactcggttattgcgaacgtcggcgaaatgtccggcttcaaaaagggcgatatggaacgcatcaaggaattcctggtgcgatcttcggatacattcgaccagaagtttgagccgggcgaaacgatcaagcgacaatggatcaccatcatggacggcaacggctacgatggactccagcgggacgactccggcaaccgacgtttctatccgatgttcgtatcacaactgcccgatgaagatggaaaaccgaactgggtcaagccgggagacggcaatgaaccattcaaggtggacttcaccgacttcggccgcaagttctggcaagccatggccgagtgccgcgcctggatcgaagagcatggcgtcgatggatacctgaatatggtgtcggaagcgaaccgcgaagtgcagaacttctctatttcggaaatggagaatgcgcgcggtgtagttcgtgacgatacgattgatatgtatctgatcaacgtactgatcagttgcgagttcgaagagatcaagccgggcaagaattccaagaatcctgggtggagagtcaacacagtcgaaattctgaaatggttcgatattctcgccagaaagaagccgatttctcgccacttaactccgcacctgaaggcattgggattcgtcccgaataagaatggcttgaatggctggtgcctgcctgtggataaggtttctcctggatggacgaagggtgtgcacacgacgttgccgccgttcaatgatgtgcttgtatacctgctgaggaaggtggattctgaggttactgatgaagccgccatgattcaaatccgcaaagtgaaagccgagcgcgcaaggatattgggcgaggatttctgatggagtgatggagtgatggagtgtacttggactaggccgccttcgggcggtcttttctttggtgcggcgtacattcgatttcggttgtggccaagtgagattcggaagctatccggtaattaagttgggttggtgatggtgtattgtggaaagttcgtggacagtgaatcgaagattttggatggtgagtgggtgaattatggaaaatcgacgattctgactggattttggggtcggccgcgagctggcacaccggtaattaccgaaaccaggaattagggtcgagccttagtgccgcgtgggattgaagagcccaaacggatactttccggtttcggaagcagccgcaaaagtatactacagcgaaaatcgattgcacaatcctaatagaaaaaatctatcacggacgttacctatctttaaaattaattaaattaatagtaatttggtaatttggtaaactttagtatttgaaagcctcgcggcactaagcttgtacatatcccgtcaagtttccgattccagccagctcgcggcagggtcgccggaaacttccggacttccaatccatgggtcgcggcaacaccacggcggactaagcggcaagtgccaaaactcgacgaacggaaccggaaatttgggagcgcgacagaatcgctcagctggacatatttctaacattcgatttaacactcaatccaaacactcaccaccatcgtctcccgccaaccgccgactcgatcctcacccaacagcggatcgcccgtataacatcctataacaccacctaacactcattcatcatcaaacccacccagacctacagcccacccacaagcagcccatagacgcgctccctggccccatagtacaatcgcgccatactcagtgtcgcggcagagcatcaggcccattcaccaaccaagccaccgcgacgactccagaatcgaactccagggacgcagcaccaaatgaccaaatactacagccccgacgatctagtcacgccacaggaattcgcagacccgcatttcgcggcgatcaaccagaagcgtttcgatctgtatatcgacctgcgcgtccaaggctacagctcctggcgggtcttccgggccatctggggcgaggagcacatggacggtcccgctcaggctcgcatcttcgcgatggagtccaacccgtactatcgcaagcagttcaaggccaagttgaacgcgaccaaaacgtccgacttgtggaacccaaagacggcgctccatgaactcctccaaatggttcgtgacccaaccgtcaaggattccagccgtctgtcggccatcaaggaattgaacgttctggctgaaatcacgttcgtggacgagtctggcaagaccaggatcggtcgcggtttggccgacttctacgcatcagaagccgaggctcagaccgcgaccgtcgctgctgcggccgaagccaatggctatgtgccggaaggcgaagagggcgatttcccgtccccgacgccggaaccgaccgaggaagaccgcgccaaccccatttagacataaaataacatcgttctaggcccgaatcggatcgaactaaggcgacggtagcgggaagggacgaaaaacgattctagggcggttctaggaagcaggagcctaaccctcagaaacgacaaagccccggactctagctcagaatccggggctttcttttgggcgccttattcgccagcttcgatgatttcgaagttgtatttgacgccttcgtgctcgaaagtcatcttgccagccgccttcagttgcatacggaatcggatgcacttcgaagaaggcagaccgaactcgatgaatgctgcgttgcaggatttgaactcgccgcgcttgcctttcacggtgaccgctacgccatgacgctcggtgcgcttgcgggcgacttccgggtctttccaggagttggcgatggctgccgacaggtctttggcctctttggtcttctccggcgcgttcttcgcctcttcgcgcatcttccggatttcttccagcgcttcctcttcggtgatttcttcttccggcttcaggttctcttcctcggccttctcttcttccttcttcttggaagtgcgggtcttgtaaaccttggccggggcttcctcttcctggaaggcctcttcctcggccggcagagcgttcaggatggcgaggcagcgacgctcagcggtcttgcggtcagagaagcgcttgacagtcgcatcggcgttgtgagcgttgtagaaggcgaccagttctttcatttctgcgttctggatgtcgccgaaggttttgatggagttggtcatttttgcgatcctctgttttggaagatttcttttgggcttcggtttgtcgcccccgttgaaagagattatgcctaggtcgatgctgcgtgtctacatttatttagcagaatgatggtgaacccgacgaacggtcgtcggatgtgaaaacaccgcaggacgggctgcggtgttttgtgggcgttggggtgatggtcagaaagtcgggactgtgataggctcgatgggcggatcgccgggcctgtcgttgtccgatgcgggcgccgggctggaagggatcgcacccgaccgaagcgccagcgattccgactgtctgcttacctgcggtggcggtggagccgctggtgcctttggagggattggaggcaggtcatttcgacccttgaccatttgcagagggtctggaagatcgggaagcgcgccagcgatttcgccatacgtccgcgccggatcgtcgccgaacatttcggcggatcggttatctttgacgatctggctgatggccgtcacatcgccgcccggttctgcaggatcgccgcccggttctgcaggatcgatgcccacgaatggagtggtcacgcagcgcatgttcggatgggtaggcagatttttcagaacgatggagtctgcccagacatacggattcttgtggttgccgggtccgtggctgatgatctcggcaggaatatggccgttcatggtaagccattccgccatcccttgccgagtcagcgggcttaccacgatctggccagtagactcttcggcgacggcgaacagatcaccgagcttgaacccgatgattatgtagttggacctggactcgccgacgaaagccagggtttcgatgttgtggtggatatcttgatcttcccagatgtacagcatggtgtcactcctctttggcgaaattgttctttcgaaggtagtaggcgatcttcagtcgtggccagaacggcgtaagcgccacgttatcgtgacggatgatcgcaaagttgtccgttccttccagccctgcgatgaagcaacgttcccaggcgctcccgctgtagcgatcatctggcttccagacgttcatgcctgagctgagttcgctcgactcccatttatgatcgatcttgacgttcctcatggcgcccctcaataaggctgcttggtgtgctcgaccagagacattccggccggaactttgaagcggacgtattcgatcatcatcgccgttcgacgccgattcgtgcccgactcgtcattgacgaatagttcgcactggtgcggaatgactcgcgtcaccaggccttcgcctttcgagccgtagaacttgatgtaggccgcgacgcctcgcgtcatgttcagatggatcgtttcgcagagtcgctgcgcggccgacgcgctggacagatctgtcggactgaccgtcacccagtaatggccactttgttctttatcggacataagctgccctccaatgagaaagcctctgcgactcggcagaggctggttgttgttagtcgcgcttcaacagaacgactttgtcatatgcgcgatatttaccgcgccagtcttcccagtagtcgccggccgggcaggtaagctccagggtgatttcgtcgcgccagcattcgacagaaagtacaattgccttgttcctggttgcggaatccgctctgagcttaatcaggatttcgtcgcccgttttcagctcatcaactctcacaactttggccatggcgttctcctattgggtcgcgccacgaggtggccatgtagcttcgatgtcctgcaagcagatggtgggatagtccctggccagcttgagcttgaagtctacccagtcagagccgatgagcgccgagacttcgatgccgactttgttgcgcgacgccgcgtaagatcgcaggactatagcacgacgccgaacgggatcattgacgtcaacatgagtgagtatttcgtcgccgacgagcaactcacaggccatcaggattttggccataatacactcctattagaaggcgcggccaggacgatcccagccgcgccgatggattaacgtttgtgaaggatggacactgcgtccacgtcgaggatgctgatggtacggcgacggcgcggattgctgcgttcatgggtgcgaatcaggtcagcggatggcgcttcgtgcaccacccatacatcctccggcttctgcgtccggagcaggaccgtcacttctgtgttctgggcgaggccgttgcagatgaaagtgaacttggacgagggagttctgtacatttcgagattcctttttggacttcggggtccgacttctcagccggtgaagagattatgcctgatcatcaccgtcgagtaaagcacttatggaccaattctccagttaaatggaaccaaagcgcggtatcgctgatcgctacgcttccacgccatggcccttcttgctcacagacttcgaaccacaagctgatttccatccttgccaggactcggcagaaggattcgagccggcgccggctagccaggatgtcgacattcaaccgccgattgatttcgtatcggcgaccgttgatgacgaagactaggcgtagggtctgtccgtccagacattcccagtatttggtttcataccgaagccagtagcgcttgccagccgggcctaccatggtcatttaatcgatgctcctggccgcgccacgcggtccggtcggcggcgcaggatcgaaccgccccaggatgtagtcgggccggcgcgcttcctgaggacacacggcgagaaggcgccatcctgcgtccagggcatactggagttcgtccgtgcagcagtcttccttgagcaggagacggttgacgctctggagattcggaccagggatggccgagctggtgtgcgagttccagccttcgatgccgtccaccatctgcggttcagatatgtagcctggcgagcgtccctgtagacggctcgcggctagctccaggcgctccagcatgggtcgcagagcagcttccgggtcaacgtcgtcccagagaaggaccaagctgatgatggtgtacggatagtccttgtccagatcccaggccgaagcggtcagacggcccaggccgatttcattacacatcacgggaacgtcgttgctccaggtggacggctcccagtttcgctcaccaggattcccgattgttacgccttccaggttccccagtagaacatggagcttgctgacatattcctcttccaaggctttccgctcttcgtcggtctggttgtggcgatagaaggatggagggctgacttttgcatggtagagtttcataactgttcctcggttttggaagatttgaaagttagagaatggtgtcgcagtatttctcgaaaggactctggcgcttcttctcgcagatcgcgcaggtgatttccaggtcgggtagctcgctgtaagtcttgccgagatacagccagcgcttgcacagactgcggccgtccgccgcgaagaagtggactttgcgagcattgccgggctgcgcccagccgccttgatcgtttttgcgcttgctcatggcgatatctctctttggatctggaatccatgccgtccgttcgctcacccatactccatctacataaatcaggactgacagagcagtcgcaccaaacccgaagcctacatagaatgagccgggatcgatctccatggtggcgctattggtggcactattgaaatcgacttcaaagtcgaacatagaatggccactcataccatcaccatgtcgatttcattgatgaagaaatggacatcgacaccatcggcgcggccggtgtaacgcagctgagtcgtcccatcaatgtgagcttcctcgacgccgatgacttccaggatggtgtcgttgcagtaaagcttgacgaacatcttgatgccggagccaatcgcctcgaaggcgatctgcttgtacaggtcttgcttgatcatgctttacgctcctgtttgcggatgtattctgccctggcttcggcttcgagcttcgcccaaagcgcgttgtcgactggaccccagggaccggtctgagttccgtccaccggtgcgaacttgccaccggcgcgacgatacttggacagagttctcaggccgatgattttctcttcttgggagtcgagttggacgatcatttgacatacttcccgaagtagcaggtgtggaggatttccatacccttggagatagccttcagcttgatgccgaaattcttgatcgcccagtccagatcgtggtgatagaactcgatgatgttgacgatttgaccggcgctgtagtggatgacgcgaatcttaccattccagcggaaatcttcgcggctgtttacggcctcgacttcgatggtgtcgtttctgccgatggtccatttggagctagtcatgtcgcaatcctctttttggagtatttcgcgtttcgatgaggtaactatacctcagtcacctcatcgagtaaagcactttgaacagatcatctgaaatttctggaagacaaatccatcggctgattcagtcagtggaaccgaggctccatccattgcgggcgaaggccgagcgaccagacagcttgcggcactggatggagctgccatcgtcgaaggtgtacgatacggcccagtccaggcgctcgcgacgtactgccgcggcagcgatgtcttccagacgggctttgagaagttgttctgctttggtcatttcaagttcctctttggagcgcttcgggattcgatgagatgactatacctcagtcacctcatcgagtaaagcacttctgaggaattatctgaagtttctggagtccagaaattgccgccagagccagtcaacgtgatcgttgagatagcgctcgccatcggacgacagagccaggcagccatcctttatgccgagcttggagccggaaatccattcgaactcgaactggagcgttcctgggcgagggatatgggacaggctgtacttttgcacggtcagtagtcctcgaaaggattcatgttggcgatggccgcgattttctgcatgccgatgcgatagaattcggcctcttccctggccttggccagattctccctggcttcgcacgccagcttgtgctggttgttggcattctggatgcttccgtccagactcctgtccagttcttcccgaagagccttctgcgacgctatctcggcctccaaatcctggattctgatctgaagctggcgattcctttcagagatctcgttttcgcgggcgatggagttctgaaggcattcgtcaaggcgagtattttcgcgcaccagctgatgcttttcgactttcgcctttctgcacgtctctcgcattgctgaaagctcactcgcatgcagatcgtcatccgggtctttacgctcttccttcgactccatccgcaggtagtactggccggctgcgaaggcgagcactgcctggtcggcatacgctgcggcatcggtcatgtatctggatttgtagcgaggcagaaacttgcactcctctggatcccagaggagactatcggcaataggccagaatttgcggaagccatcaggatcgacttctacattgaccatttgcagctggccggcctccacttcgacttccagaggaacctgaatggtgccggtgatgtactggaagtacactatgctagacataacacaaactccatgagaagtcgcggccgggaccatcctggccgcgcatcgtaatcaatcttcgccttcgtccgcgctcagccactcttcgaaggcgaagtttaccttcgactcgacccaatcctgaagctcatcggcgaactcgtcactgtcgatgtccatggtgatgcccatgacttccatgttccatagcgcggcattcagttcaaactgcaccatccgctcgccatcgacttccataaggatgcggtctgcgacttcatagtcgtctacatcgaacaggtggccgccagtcaggaggtgctggacgaaagcttcatcgaggttggcgacttcgatctggacttgtttggtcattttctgcgatcctctgttttggagtttgggcgcccggcgaaccgggcggggtggttaggccggggaaatctcggccgccgtaaaggccgcaatgcgaccgctattcagcctgacgaacaccgggaatgcgccgccctcgcgaatctcgctgatcacgccgtggccgccgccttgcgcatagacattctgtccaaccgacaatttcttaaggctgtcgctaaaaactacggttttcatcgtcttgccctccagggcgggaaagcccggcaaaccgggcgggtgattccgttacagcaggccggctttgcgctcagccttgatggtgtacacggcttcgtcaaccagccactcttcagcttccaggtatgctttggcgacttcttcagtgaccacggccaatttagcgacgctcaggattttggcttgcttagtcattttcggcttccttttgtttgaaggtt

SEQ ID NO: 12 - DNA, 45080 bp, artificial sequence
  BP1661
atattccccagatacaccggaggataaaatagacttttggggtaacccccggttataggccctggatcaaagcacccttcgatacctgttggtatattactggataaaggggcaataggccaggacatagcaaacagaggtagacttaaggtatacctatagaacctggatcaagggaaccctatgccacttaccccttaccagcaacctacgaagggtagtcttagggtatatctatagaaccctatcataccgttcgtcgggtaaatcatgtgattatcaaagaaatatcaaaaagtacttgacaaggtatccaaaatgtagtataatagacctataggctcttaagattccttcttccttttgacttacttactaagaaggttagttatcctaaggttatcttaagatagtcttaagaaccccttccccattccagcaaaaaccctaacaaatccgggtcttgcgactaaaaataaaaaaaagatgaaaaggggcttgacaaaatagaaaaagtgtgatataatagtattataaggttgagaaattaaccttaagggtgctttagaattcattgggatgtagctcagttggtagagcagggagctgttaactctcaggtcgtaggttcgagccctaccgtcccagccattatggcccattaactcagcggttagagtgctcccctgtctagggagaagccgtcggttcgaatccgacatgggtcgccaacaaaggtcgttgtagaggtagatggctactaccatccggctgtaacccggacgccataggctagaggttcaattccttccttcgaccaccactaactcctcgtagctcagttggttagagtgcctgtcttggacacaggaggtcgtaggttcgagtcctaccggggtgaccatttagagagatcggagcagtgtatgtcagacgaaaaggttgtctcgattggggctgctcctctttctgctaaagaaaagctagacctctattgtgaggctctggcagatggtatgaacaaaacccaagcatatatagccgctgggttctctcctaatcatgcgcaacgcaacgtagctgcataccatcgaaagcatgccgaatacatcaacgcctttatctctgagcgcatcgggagtcatgtccctatggcgcttcgtgtggttgtagagatcgctagcaacccagaagagaaaggtgggattcgcctcaaggcggcccaggatatcctggatcgtgggggcttcggagctaagcagaaactggagcttactactaagaatgtggaagatatgtccgcagaggatctaatcagtgaagttcgacgaattctcgacgaagagccagagttggctaaagtcatttctttcccagcctcttaagtaccttgatctaatcaagcgaagagaggggttggtactaaagtggtacaaagactccctcgggaaagtaactggtggttatggccacttgcaactccctggggaagacggaccgattaccctagcacgagcagagacttggctagagaaggatagtaaggcagcctatgatgcagcccaagggcaagcatctcagctgcctttttgcactccagagctattcgatgccctcgttagcgtcaacttccagctgggtacagcgtggacgaagaagttccccaagacgtggaatctcctgaagtccggaaggtttgatgaagctgcatgggaggcagaggatagcctctgggctaaacaaactccagtgcgcgtaagggacctccaacgggccctctggcgtgcatcaacagtaggtgacaaggtggtctaatggatacccaagagcggctacggaatctagtcagggagctggctgagcggcagaagtatttccgcatgaaccagtacactccttatgggtggcaagagaagtttatcgcagcttcctcgaactgcgcccagttgctggctatgactggtaaccgctgtggtaagacctacaccggggcctttatcatggcctgccacctaaccggtcgttaccctgagtggtggactggtagaaagtatgatcgtccagtgaactgctgggcggcggggatctccacggataccactcgggatattcttcagtcagaactactaggtgactggaagaaccctgaggctttcggaacggggatgatccccaaggaagatatcgtagagacgattcgtagggaaggtaaacccggatgtgtgcaagcagtagttgttaagcatgcctccgggggcctctcgtccctcatattcaagtcctacgaaatgtcccaggacaaattcatgggtactgccatcgacgtcatctggctcgatgaggaatgccccaaggatatttatacccagtgtgtaacccgaacggctactactgggggtattgtatatctgacgtttaccccagagcatggtctgacggagatcgtcaaggacttcctccaggatcttaaacctggtcagttccttgtccatgcaagctgggaagacgctccacacctcagtccagaagttaaagagcagctactctcggtatactctccagcagaacgcaggatgagggccgagggtgttcctatgctcggatctggtgtagtcttccccattctggaagagaagtttgtatgtgagcctttccagatccccgatcacttccataggatcatcggtatcgacctcgggtttgaccaccctaacgctatcgcctgtgtggcctgggaccctgagaaagacaaatactacctctatgatgagagaagtgagagtggtgagacccttgggatgcacgctgatgctatctacctgaagggtggtcaccagatcccggtagttgtcccccacgatgcctttaagcacgatggagcaacctctggtcgtagattcgtagaccttcttaaagatgaccacaacctcaatgtagtgtatgagcccttcagtaacccaccgggtcctgatggtaaacacggaggtaactctgtagagttcggtgttaactggatgttgacccgtatggagaatggtgatctgaaggtatttaatacgtgtacgaacttcctaaaagaaatgaaaatgtaccaccgaaaggacggaaagattatcgacagaaacgacgatatgatctccgctacccggtatgccctgttgatggcttcccggcatgcacgtcctggtgctgtacgaaacagtggatactacaggagtgatactgcaaagttgacccctgattggtttgggagtattgtctaatggctaagcgtcgtcgcaagattaagcctatggatgatgaacaagtacttcgtcatctagaccaacttgttaacgacgcccttgatttcaactcttcggaactttccaagcagcgttctgaggccctgaagtactacttcggagagcccttcggtaacgagcgccctgggaagtccgcgattgtatctagggacgttcaagagactgtagactggattatgccttctcttatgaaggtattcacgtcaggcggtcaagtagttaagtatgaacctcagactgccgaggatgttgaacaggcagagcaagagactgagtatgtgaactacctcttcatgcgtaagaacgaggggttcaaggtaatgttcgattggttccaagacactctgatgatgaagaccggggttgtaaaggtctacgtggaagaggtcctgaaccccaccttcgaacggttctctggtctctctgaggaaatggtagcggatatcctagctgatccagacactgagattctcgcccagagtgtggatgaggatggaacctacagcattaaaattcgcaaggataagaagaagcgagagattaaggtcacctgtattaagccagagaacttcctggttgatcggttagctacctgcattgatgatgcacgcttcctctgccaccgtgagaagtataccgtaagtgacctccggctcctgggtgttcccgaggatgtactggatgagctcccgtacgatgagtatgagttctctgatagtcagccagaaaggttggtacgtgataactttgatatgacgggtcaactccagtacaactctggggatgatgccgaggctaaccgtgaggtatgggcctctgagtgctacacccttctggacgtagatggggatggtatctctgagcttcgccgtattctgtatgtaggcgactatatcatcagcaacgagccttgggattgccgtcctttcgctgatctgaatgcctatcgaattgcccataagttccacgggatgagtgtctacgataagatccgagacattcaagagatccgttcggtactcatgcgcaacatcatggacaacatctaccggaccaaccaagggcgatctgtagtcctggatggccaggttaacctcgaagacttgctgaccaacgaggcagcgggtatcgttcgggttaaggccatgaactctatcatgcccctagagacccctcagttgtctggggaagtctatggtatgctggatcgacttgaggcagacaggggtaagcggacaggtatcactgaccgtacccgaggtctagatcaaaataccctacactctaaccaagcggctatgagtgttaaccagttgatgactgcggctgagcaacagattgacctgattgcccggatgttcgcagagactggtgttaaacgtttgttccaacttctgcatgaccatgccattaagtaccagaaccaggaagaggtcttccagctacgaggcaagtgggttgctattaaccctgccaactggcgagagagatccgacctgacggttaccgttggtatcggaaacatgaacaaagaccagcagatgctccaccttatgcgtatctgggaaatggcccaggctgtagtagggggtggtggtcttggggtccttgtctctgagcagaacctttataatatccttaaggaagtcacagagaacgctgggtacaaagacccggatcgcttctggactaacccggattctcctgaagctcaacgggctaaggccatcagagagcagaaggaagcacaacctaagcctgaagatatcaaagcccaagctgatgcccaacgtgcccaatcggacgccttggctaagcaagcggaggcccagatgaagcaggtagaggctcagatccgactggctgagatcgaactgaagaagcaagaggctgtccttcagcagagagaaatggcccttaaggaagcggaactacaacttgagcgtgatcgtttcacttgggaacgggctcgtaacgaagcggagtatcatcttgaggctactcaggctcgggctgcttatatcggagacggtaaagtacctgagactaagaagccctcgaaggcagtgaggaaataatcttgggagaacgttttggctatagtctagtgctgtctgatgcggcacaacagatggtacgtgagaacgttcttcctgagcttttccgtattgtccaagaagagatcgagggagagtggaagtctacggcacctaaggattcagaatccagggaggccatctatcatgaactccacgccctcaaccgcgtacaacttcgtattcaggctatcctggattcgatcactctaaaggagtataagtaatggaccttgagaatcaaggcatggatgaattcgaggcagcggaagccttcggagatttgctaggtgatgacctcctggcccccggtgatgaaaccgtggatggtaaagtcgtaggggaagaagaggaggaagaggtagtagacgaaggtactccagaggacaccgaagaggttgagtccgaggaggaagaagagggttctgaggaagatcccgaggttgagtccgaggaagatcctgaggataaactcttcgagatcccgattggggatgaagtctacgaggttaacttcgaagagcttaagagtggctaccttcgtaatgaagagtttgtaactcgacaatctgaactagaggatcagtatgcggctaagttcgaagagcttgatgctgaacgctctaatctactggccgagcttgagcagtatgctgttaccgctatcgctggtgctaatcagtatgacaatgtaaactgggagcagcttaaggcccaggatccagagaagtatcaaacccttcgactggaagccctggaagcccgagaccgagcccaggctcttatcaaacgccgtaacgacattaaggctatgcaagagaagcgagccgagattgtccactctgcctacgttaagcgtcagacagagctagccaagaagcttatcccggaaatgactacggatgagtcttggggtgacaagattgtgtcctatggcaaatcgattggatactccgaggatgagatccgagggatatctgatgcccgccaactggctgtacttgatgcagcacgtaagtgggctgaatctcaggtccgtcgcaaggctgccctagagaagaaggaggagactgaactacctgccgcagttaagcctgctgctcgtagggcggaagcctcagagggttctaagcgggttaaagctgcccgcgctaatctgaggaaagatcagtcggttgaagccgctgctgctctcttctcctctctcgatattttctaatagaaggaaacgtaacttatggcaactccaactaatgccgtctcgactgtagagatcaacggtaagcgcgaagaccttatcgatatcatctacaacatcgcaccctatgacaccccgttcatgactgctatcggcaagggcgtagctaccgctatcacccacgagtggcagactgatgaactccgccagccgggtaagaacacccgagtggaaggtgaggatgcaaccatcaaggctggtagcttcaccaccatgctgaacaacttctgccaaatctcggacgagaccctgcaagtcaccggtaccgcagataaggtcaagaaggctggtcgtaagaacgaactggcgtatcagctggctaagaagtcgaaggaactgaagctggacatggaatacgccatggtcggtgcccctcaggctaagatccagcgtaacaccactactccgggtcagatggcaaacatctttgcctactacaagaccaacggctcggtaggtgctaacggtaccctgccaactggtgatggttccgacactggtaccgctggtgacctccgtcttctgaccgaagacatgctcctgaatgcctctgaggctatctggcgtaacggtggtcaggctaactcgatccagacttcgagctcgatcaagaaggccatcagcaagaacatgaagggtcgtgcaactgagatcaccctggatgcctcggacaaccgcatcgcgcagaccgtggacgtctacgagagtgacttcggtaagtacaccattcgtgccaaccgctggttccacgaaaacaccatgttcatctttgatccgaagatgcacgccctctgctacctgcgtccgttcttccagcatgaactggctaagaccggtgacagcgagaagcgccaacttctggttgagtacaccctgcgtgtaaacaacgagaagtccggtgctctgatccgagacgttgtagctcaggtctaacccaacggggcccttcggggccctttgtttccccttaggaggtacatcatgagtatccaatcgacttatgcaattgacgaagaccttgggctctttatccgaaaggatactcaagatgttgagtcaatcctgtccgctaacgccgaagagcgccactcgggtgtcaatagcaaccgtaaggataatatgcgcaaggtagcaagtatccccttggttgtcgtagaggcactacggaatcgtcccatggctgaaggtggtcccatcgatcttaatctgattggttgtgacccagaccatgccgcaagatttacccgttggcttaatgaccgagataactatcggatgcggacctctgaggcacgggtgtaatgaatggctacgatcaacaacgtaactgatctcgctattgccgctatccagtggtctgaccgtcaggaccttacccaagaacttctgatgttgttcatcgggaacactactgaccgtcttaaccgattgctacgagtgagggagaacgaacacttcgaaactctcatggccttcggtggtggcattgagatccccgagcattttgttgctctaaggtctatcacgggtgactctcttatcggtgggcgtactcttcagtacatcacccaagacatcttcacccactatgttaactacaactaccaacctcagggtgtaacctactacactcggttgggtaacttctggcgagtattccccgttgttcctgacggtgccccgttcattgtgaactactggactgtactcccagagctaagcctcgctaacccaacgacttgggctctgacgaagtatccgcagatttatctctatggtgtccttgagcagatttatctgtacaccatggatgaagctcggtcccagttctggggtcagaaactcgaacgggctgttatggaactccagaacgaggagaatgccgctgacttcgctagcactcgactggcgatcaaagacattgaacgttaaggagcttcagatgcctatctttctaaaaaccctcgcaatcaaccttctggctaccctcttcccaaccaaggtaatcgctaagtccatcgtgactggtgctaaggccctggcggagaagactaactctaaggttgacgacgagttcgtaaaagtcctggaagacaaccttaaggagaagacggaggatgcaacttctaactgataacctgggcagcatcgtcagtgccctggtcgtatcctcggtagtgacgataggttcctcggttgtcggtcagaatgttcatcaggctctgcttgaaagaaacatccaggccacggagaagctcacccaagcggtgagcgatctccagatttctatggcaatctttggggagcggtatgtcacccgaaaagaaatgaaagaagagataaaggaggccaagaatgggtcttgaggtcgcaacttacattaaccagttggtgcctacgaaccctaccggctctgatctgaaatcctttggggatgaccacctgcggctcattaagagtgctattaagaacaccttccccaatatttctcaggctgtcactgtaacggcagcccagctaaacgcagtcgctgatacaacccagtatgttaaacctgggatgatcgtcatgtggactggtgccctagctcagatcccagcaggttggaagctttgtaacggcgtaggtactacctctaatggtatcccgatccctaacctgattggggcattcccctggggtatcgatggttcttcccaggttgctggaaccagaggtggtagtgctaacattgtatgggatggattcactgaggggactgctcttactctagcccaaatcccagcacacacccacacttggagatcccgaggggctaccacccttaccggatctgcgggtgactcgggtgctctgacgggaggctctggtaacgcagccaataccaaccttgagactggtcctgctggtcaaggtcagactcacaaccatgcagtaaagatcaacatgccgttgggtaatatcccaccgttctgttctgtgttcttcatcattaagaactgaggtatacaatggccctagagagacaagaggtcaagaaccctacggggattgtgaccgatatcgcccccgctgacctgccactggagaaatggtccttcgggaacaacgtccggtttaagaacggcaaggctcagaaggctctgggccatacgcctatctttgatacagcccaggccccaatcttggatatgtttcctttcatccggaataatattccctattggctcctgtgtggcgaacagcgtatgtacttggcggatggtactaccattgtggatgtatccccaggtggacactctgcaagtgtaaccagtagatggtcctccggttcattcaacggtgtcatcttcgctaacaacccaagcaactacccttacgtgttgatgccccagaatagcggatttatccctatgcctaactggcctgctaacacattcgccaaacgtatgaagtcgttcaagaactttatgattgccttgaacgtaactcagaactctgtagaaatgccacagatggtctggtggagtacctcggctgatgctggtggtgtacccgcttcttgggacccaacggaccctactaaggatgctggtcagaacaccttggctgataccaatggtgctatcgtggatggtgtgaagcttcgtgactccttcatcatctacaaggaagactctgtatactccatgcggtatatcggtggattgttcatcttccagttccagcagttgtttaacgacgtaggtatcctcgggcccaactgtgcagtagagttcgatggtaaccactttgtagtaggtcacggtgatgtatatgtccacaacggtgtgcagaagcagtctgttattgatgcccaggtccgtaagttcttcttctcggatattaaccctgacaactatcaacggaccttcgtacttgcagaccacgtgaatactgaaatgtgggtatgctactcttccactaggtctgagccaggtaatcactgcgacagggctatcatctggaactggaaggaaaacacttggagtatccgagaccttcccaacgttctcagtggagcctacgggatcatcgatcctaaggtgtctaacctctgggatgacgaccccaacccctgggataccgatacttcggtctggggtgaaggctcttataacccagcaaagtccagtatgatcttctcgtctttccaggataagaagttgttcctcttcggtaataactctacattctctgggcagaacttcgtcagtacccttgagagatccgatatctatctcggggatgatcgaatgatgaagaccgtaagcgctatcattccacacattactggtaacggtacttgtaacatctgggtgggtaacgctcaggtacaaggttctggtattcgatggaaaggcccttacccataccggattggtcaggactataagattgacactaaacatgtgggccggtatatagccttgaagttcgacttctcttcggagggggactggtacttcaatgggtacactattgaaatggccccgaaggcaggtatgcgatgagtcaaaagtacagcccttcgattccaccacaggaagaggaggaactgctgcccttccttaatgaagaattcgttagggttggacagactcttaatgacctagctgacggctactggggggtctctatggagccccctaagaagctcaagccagggactgtaaagtattttgcccccggagtggtaggtccagtatccggcatctatcattacgacttggataaccaatggagactcgcaggtactaaacccaaggacctaccgggggactttatcctatttaccccacagaacaaccatcagccgatgggtacctgtgcctataggatgaacactgctaaggatgaggtatggataaccatgcttatgtccggtggtaactacactaacgggtctactgtcctggatctaccccaggcgtattggcctcctgctgagttgtttatcccggcctattccagcatcatcccagcgcagagcactattacttatccacctccgtctgaccctaacgcacctccgttggatcaagtctttgatgttctcaacagggctactattcagactggggtggttaaccaagcaatgtttaagatcacagctaatggccgtgttctaatccaaggaattccccaaggagcagtcttcgggggtacattcacattccccctggtggtgactccatgattcatttgattactcgtgagaatatcgatctgcttcctaccgtagtccctgctctggcccgagccttcaacaggacggacctcggtaagttttgggacttcgaacacttggttcactccttggttaactacgaggcctatgtcttctaccaagaagagagtggctacgctggtgtaattcaagtgtcccaagcacccctgggtaacatccttcacttcttctggagtggtaagatgcctgggaatgaaaccccggtagattactcggaggtagacgacttcctcggacagttcgcccaacgagttaactgtcggtttatccaatgcgaaggtcgtcggggctggaagcctaccctagagaaactcgggtacaccgaagactccgtatccttctatcgtgaggtaactccagatgaacttcctccaatttaatgtaaagcgtctgatggggttcgatgtagaggatgccctagactctcgggcttacaagggtggtagtaagaagcaaaagaccacctctgtctctacaccctatcagcaaggtaactataatgaactactctcgggtgccagtgattggctacataacgggggctttgaccccaattacgggggcgatccgaactttgacccggtggctgaccaaaatgctctccagcttggtggcatcgaagggctgggtggtctcgggggtgcccttcagtctctcctgggtagctcaggtgttagctctctggctgattaccttggtccttacgatcccaacaaaactggcttggcgaacgccattggtgcagccaacgagcagatgcaatgggacttcgacactacggtacgtccagacctgcgagcaggggctaccaacgctggtcagtatgggagttcccgagcgggtgtagcagaaggtattgctaccgctaggttgctccagaatcaacagaataacgcctcccagttggctttccaagaccagcaggcttacaaccagaataggttgaataccctgggtaacctgtcggctattgctaagggcctcggctctggtaatgccatgcaggtagatgctggtagcatgcttcagaaccaggagcagcaggaaatcaacggggctctacagaagtgggcttatgagaataacgtcagccttaacgacctactcgcctataaagagcttatctccggcgacatgggtggaaccaacgttactacttcctcgggtggtggcggtggtggtggcctcgggtctgccctgggtgctctcggtggtgcttccctgggtgctctcttcggtggtccagctggtgcttctgttggtatgaacgcgggtggtagggtagggggccttctcttctaatggcttcccttcctcagaaactgttcgctataggacagaacataggtggtgggcaggagcgggttcagttgagtcgtcaaggctcctaccgccccacccaccttgggacgatgcaatcgggagagtctagtggacaatcaaacccttttggcgcaatgggcggagcagcactcgcggctctcctcgggcaaggaagtgagccttcttcagaagcagtaccaagcttttctgtcgagggggctagaggagcaagcgaacgaggcgcagcggaagttgcagcaggtatgggagcgggaatgggaatccttcctagcgcagaagaactcggtttcggacagcagccaaagtccggaatcctaagtaaactatttggaggttaatcctatggccagcatggcttatgaagggtccccaattcgccctagcatccttcgggctgctcagaatgaactggacatggcgcgaatcgcaaggaacaaactgccgctggctgtagagggttcaggaatccctgatcgtgtccgccgggctgctcaggctgccctagagaaccctgaacgttggtctcgggctgcccaggaagtggcccctgcggctgaagctactggtcgtggagccctgggtcgtatcgcaggtatcctcggtggtccagtatctgttggcatccaagcggctgtaaccccaggagaacttggggatgcagagcgtactcgtgctgaagaaatggctcaggctagtcaggctgtggagaacatgggtcccgaggttgctcaagaggctaaccagtgggcccagggtgtaggccaacgtgcagcccagaacgccacaggaggccctacgggggctgaactcctgtcctatggggtaacccctaaccaaccctctatcgagcctgatatcgctccagaggtggcctctgcggctggtgctgctgttgcagacgaggaggaggctaatcgtcaggttatccagcagggtgcagccgagggtcttcgtactggtgctgtaagtcgtcctgaaatggcccaggctgtagttgaagctgatgcccagagagagggtgtagagcttaaaccccaagagcttaaaactcgggttaatgaagagctcacccagatgaggactatggataatgatgacctgtctcgttatgtatcttacgctctcattggtactggtcttctggcttcggccctagacaagactggtaaggctggggatatgttcgctgcctcttatgagcgtcaacttgatcgtaacctccaggctggcatcaaccaacagaagatggctgctgctgctgctgatcgccagatcaaggagaaggatcttgagcgtaaggtggctaaggatgctgctgatgtacgtctaggcgaagggaacctggaggtcaagaagggaacccttgaggaaacctctcgtaagaacactggtcttctggatcggtgggctgaggaggctgctcgggggagagccaaccttgccctaacccagcgtgaacaggatctggctaatcaacgggcccagctacaggctgaaacaacccgtcgtggccaggatatgtctcaagagaatgcccagcttagttctgctgtacgtctgaagactgctaagatcagcgctcaggcacgtcaagcggcagctaaggcagcccgaggtgaagctgttactactaaggacgcccttggtatcctgagtgaagtcaatggttctcaggctctgggtggtaagaagctgagtaagactgcccaacaggctattgcccagactgtccgaaatgaacttcgggctaatccgggggctaaccctgtgggtattatccagcgggaggctgctaagcttcaacctacgggtaactggtttggtgctgatctggactatcctgccccaacccgataaaaggtacttgacaaagtatccaaaatgtagtataatagacctataggctcttaagattccttcttccttttgacttacttactaagaaggttagtatcctaagatacatcttaagagcctattctctttccagcaactagaaggtgacttatggctctttctccagaactgaaggccgctattgatgcggaactggctgaggtcaagggcctcgacgtagccgctgaattggcttccttgaatgagccagaggttatcgaagaggcaccccaggaagtagcccctgctacccctgagcctgccccagacctgagtgtcctagtaactccggctgaccctaattctattagctctgcgattggtcgcggggttgataccatgcagtctaacatcggtggtaccattgctaccctcggtgagttgactggtagtgactacctgaaagactacggcacacagatggccgaggagaatgctcaggaagcgtcacagtacggaacccctgatgttcggtctttcgctgatatccaagatatcccatccatcggttcgttcctaaagaataacattgtagaggctctcccttcgatggcccctgtacttgctggtggtgccgcaggtgctaaggctggctctgtctttggggccccaggtcgtatgggtggagcgctcattggttccttcctgagttccatgggtatcaacgtaggtgccctgagtaaccagatgaaggaactagaccccgatcaaagcaacccatggaccgcagtcctaggtggtgctggtctgtctgccctggataccgcaggggctggggttatcgctggtcccctgttgaagcaccttgggaaagacggggcataccatatgctggtacagtccggtctacccaagcagactgctattgaagcagttacccaagctggtaaacacgctgtagtctctggtgtggctgaaggtgttacctctggtgcccagcaggccctccaggacactatcgcgtatgatgccgttgggcagacccaaacccctgagcagttcatggataacctcctgactgctgcattcactggtaccgctatgggtactgccggtggtgctgtatcctcggggatggacaccctgggtcgtcatcaggactccgctggatctgccgtggttgatcctaacgcccctgaggcacctcctaaggcttctgagtttgaacctaggggtacggtcaagaaggcttgggatgcccttggaaacgaagctacgtccctcctagagccacttgctaaggcctctcctatcgcccgtgagttctctgagaccttcagggctgatatgagtggtaagcgggcctctggtaagactatctttgaggaccaggaactacaggcaggtaagtggaattctgaactagataacatctttgagggtaagtcttccaaagagatcgataggattatcgctgatacatccgctggtgtcaacactccagaggctacccgtctacgttctttgatggatgacgtaaggaatgaggctgttaaccgtggtggcatgtctgttgggactatccccaactatatgccctttgggctgtcacctgagaaggttcaatccccagagttcctgaacgatatcactccttacttccagaaccgacaagctgctgaagatgctgtagctaactggctggctgaagtctcggatgatactcgtggtaacactgcccctgaggttaatcgattggttactcagaaccagcagactggggcttgggaagtagaccctcgctaccgtatccagggtgatccagatactttacgtggacggtttgcccagagtgatgcggtacctaagtatggtcagctggaagagagtcgggcctttgggtccgtgccccaagagatcctcaataagtattctcttaacgatactcctaagaagcgtctccaggaaatccgagattacttcgaaggggcttcccaccggattgcctttaccgaacggtttggtatcaatggggagaaggctaacgctaagattgcttctgctgtagctgaggctcaacgggctggtaagagagtcactaaggaagaagtggatcggatgtatgacctagtggatgcctacaatggtatgcacggtcgtatcaaagaccccaaccttaagaagctggcggctgttacgtcaggtgccctcgtgctctcccgactacccctcgcagggttctctaccctaactgagttcagcctacccttcgctaaggcgggggttatgcctacccttggggctgtactcccaaccatgggtgaagtagtaagacaagcagcccgtaggatctacagtggggttccaaagtctgagaccggtcggtttatgagtgatatgaaccacaccctggcctctgctacctctctgatggctgatcgggttggtgctgaggtgtttaactctactatccaaaagacgatccgtggtcagttcctcattaacggcttgtccatcctaacccatgttaaccgaatctttgcaacagagactgccaagagggtctatcagaacaacctgatggatctagccgcaggtctccccttcagttctgccaatggtgctctgaaggttgctcagcttcgggaaatgggggttaacatcggtagccagcaggatgccctcaagttgatctccccggctaccccatctgaagtcctgatggctaacaacgtcaagactttggccatgcgtcggtttgtagatcaggtagtcctcgacccaaccttcgctgacaagcctatgtggatgagcaacggaaacgttcagatgttcgccctcttgaagggttacccagcagcctatggtaacatcatcctaccgatgttccgtagacgaatgagcccacacttcgctggttcctggaccaacgctggtatgggtgcctcaggtgtagccttcactcttggtctgatgatgagtctggggtatctccaggatgagcttcgtcaactggctaagttcggtgggtctagccgagaggatacccgtagtccagaacaacggatgatggacgtagtgatgcaacagatgccactccaggcttctatgatctacgacatgctgacgggttaccgtcgagggactacccccgcagaggtactattgggtccagtagctggtgctgcaactgagggtgctatggctgttggtaaaactatcgcttcgtttggggatgacccatccgcaggtgaaatctggaagttcttgtataagcaaactccagcacgtcctttcgttgccggtatggaagcgatggaagatgctctggatctttaaggagaagtaatatggcaacttatgtagaaactgatgccgctggtcctggtggccgtgcctacgtggttgatgtgccaaaagtcttccgacgtaatgccgatggtgatctcattgagattacctcggatgccggtcgggtaaatactaatatcgttaccgctacagagttcctccctgactattatgcagttaaggagaacgcagccctggtagtagagaacgttacagcctccttcccggagaacccctcagaggccgttatcccctctgttctggttaacaccctcgtgggtgctccaggggaaacctctggtggtaaccgtgaccctggccacgtgattggcctcttctcggagaccatgattgaggcaccttgtggtactgccttcggtagtgaattccgggttgacccccgtcgggaacacctgggtgtttacgtggctattaagcacgtgattggcccggatgaccaaaacggtggtaccatcggggattacattatcgagcagtttgatgacatgcgtgatcctgtgaagaacattggttctctccaacagaactacctggacccccgactggtgactactcaccttggtggtaatgtcgtcaacacccagcagcttactcagaacattaccctgactaagcagcagtctggttggttcttcatgtctcaagggaccacggatatcaccgtgactcttggtccagatgtaaccccaggttgtcacttccactttatccaagggtctacagctaagatcaagttcgctgtatctcctgacaaggcttggtatgctaagggtaatcagacggagactgatggtcaatttggagaatgcactgtccgagtgtatcctttcggtggtaccgtgggtaccttcaaatcggcagtttaattaggagttagattatggcaggttatatcgctgacaacgacggcaacagtgtattcgttattcaatcgaaagctattgctgtacgcaatgaagatgggacccttcgacaagtcattggcccgaaagactttgagccagtgaagtgggaggatattgaggggaagcctaagcttctggaggtaggtgctaaggctagcgaggctaaaccaggtaactggaaacccaaggctagcgaagtgagtggcctatatgaagccattgcggcttccatccaggataagatatctgagatccccgtggcttcctatacggatactcacgaggcactcgtggataagttcaatacactactgaacgctctccggagctaaagataaggccccttgggataacacccttggggccttttttttggttactcgacggggtggtagataggagtatcttcggatatcctgtccatgtggtcccggatgaagcaacagctatcctgtaggttctcgaagactacaggaagggactctagatacgagctgacacagtggatccccatcccctgttttctctgctcgaaattcctccaacgaaaccattgcttatactgagggaagaagaacttccccacttgcttcactcgatacttcataaggaacctgcccaagataacacttcaacgagtagtctggatatttctccaatggtcaggagtaacatcagtcagctatatcctacataaaccagcagggcaaacaaggctgccaccgcaatgtaggtccaagggaatccacccttaacttcttgatcttgacgcataacccctccagtctttatagaagacgttcgaccgttgatctacgatatccaacattgagctaaggaagagatattcttccgtaatctctcggactttatcagaagcaagctccagttccgcttggaccttcgcaagattgctctccgcctcttcaagtgctttctccagttcagcctttgtcatagtacaccaccttgtcactgctcctgagaacatactcagcgtcaatagtccaactcatggtcgggcatttgatccgaatcatcttgggggtaaacccatcgacggttccaatggctagatgggaggaagtgttcctgtggaccaggaagactacactgtcccccacctctagtttacgtcctactcggtctttcatagattaccccaagatatccggaaggtgaacactggggatgtagaggatctccaggacttctatggaatacatccctcgcctaagcccctcctcagcaccccctttcccaaacttcatatccagccagagttctgcggagatcggcgtcttaaacgccaacccccgttgaccgaagtcatgctcagacttaatatagtacaggtctggcaagaacttactcacaggaactcctccacactcatcagcttgaggtcatactctccatccttgtggttccggaggagggctacgcctcgccagtggtcgttaccctgaggacccttgtaggattcatcgtgggtatagaagctaccgactaccaatccgtggattcgcttcttacctactgcctcgatgtggtacttgaacccctgctcatggccttggacgaagctgcgcttgatcttattgaggcgatgctcggcactcccgccgtatggccgaccactgttgggattgtagaagtagtgggcgaaggcgacaccttcgataacacccacgtcgaggaaatcatggacaatccaatcggacagatcaaaatgatcgtacccaataaaaccttggagagcagggttagaattttcataccgcttgatacgctcctcgtggtttccgatgaagaagtgcatttctggtcggtagatacgcttcttacaacccgcttggtgttgctgtaggcggcgaagaggatcgagcagaactcgcatcgcatcattaccagcttgtatgtcagcgaggactcggcggccttcgatcttagcggtaccacggtcgtagcttgacaaactgggcatgtcccaatggtccccaatatgaacaattcgcttggggcggttacgtgcgatccactccccaaggttcccgaggtggtcgatgttgacctcggatcgaacttgggtgtccgcaatgacgagagtgtcttcattatacttcttactcattagggaaggactccttgaaagtctctagagtaaaccagcggaagccattacgttcggcccattccgccatggattgctttgtgccatctttacgcttactaagccaatggcaagctgtgttagggcgctcgaagataaacacaagttcagtatctggagggagagcctccctcacccagatgtacttagatgcctccgaggcttcctggaagtaccccttgacctctaccagcaggtgcttcgtcgatccacaaggttgtgaggtcgataccttgaagtcgggcttgtacttgtgctgtatgacgtagctcaccgggtctggcttgaactgcatccagggcatcgtctcgtggacgatcttctcggtttcgctgtcgtacttcgtcccaatcaatgacttcagtttctgtctgaagaacctgccctgctttgccaattagaccctcctcttgaagcttccagataaccgagagtgtcccttcagtcaggatagaattagaccgaaccagaagccagatccaatcccccaggcacacccggaactccggatacttcagtttgatacgttggatatgagagacaaccttttcaatctgattgtcagttagtggttgagaatgatccagaagagggtctaggactcggttaagagtaatgcacttctcttctttatcaaacttataagcccttgaacggtagatttgagatttcagtccacggatacttatgggccagcatgcaatctcacacagtcctacatcgaactctgctggatgggagtgagtactcacgacaaggttgacgggtaggtcaacaccaatggattcccacacatcaaacccctcaggatacccatcaggcttatccccagtcctacaccggactttcttgtggcccagcttattgtagaaccgagtgacctctacctctagggtatcgtcatcacaggggatcaaccgtggtccaaagcgactacgccgagtatcagtagggtcctccacgtatggcctacggacatagaggtcgatatccttgggtgcaatcccgttgtctgcatcccgaaggaaaccaccagcgaccttgtagtcagtaaagttaagaccctcaaggatctcaaagaggccttcacagattttctgtgcttcctcaatagaatatttcttcatcgtcatagggaatctcccaatgtttcttcagtgagcagtgatactcgttaccggactgctgaatatcaagccaagagcggtcccgaatgaggtagaggagacgaaaattctccagaaggtactctttccaattatctccgtacttctgttggtaggcgtaagcgcaagctgcgaagagatccctctcactagaaagctccccaagcaaatctgccgctgtctttggtcccgtccctgggaggcctggtatgttatccacggagtcaccaacaaggagttgcccgtagaggaatgccgtaccgttgccctcaagcttccatgacttctggggcttcttaacgccatacattctccaagaagcggagacccttccaagaccatcaacttgaaacggtcccaattccggctgggaatctccacagggccaactgtaatggtagcatcctgggacttggcggatatccttgtctctagaacacgctgtaaagttatctccctcttcagtccctcgaatcccgagccagtcatcagcctcgataccgtggaaagtgattgctccccacttgtccttaagtctggctgacacggtttcccagtgatgaggcttttcaagaccgattcgagtacccttatattgcttgattttcgcaagctccagcctaaaatttccttggccagtaaggtagatttcacactcatctgcattcacccttttgataatttgttcgactttatcatcgacgagcttgtggacttcttcctcaggccatggcttctccacctggatatcgaagatgtgttccttcgacatagccacgtggcctagctcatacctaagaacgtcaccatcgataccagcaatcattacgttacctcttctacgacctgagactctttgagcttctcttcccagaatacacggagggcaaaggcttcacccttggctcgatactctgggtgctctaccaccggattaaccagtgcttcgtagcccttccagtcgtaatattcactctcttgacgcttggccttgtccatagcttcctccgttaggctgtagcctgggggaagccccaggtctacatcaacgccttttacagagtagttgctaggaacagtcttagcccttggatccaacagaagttccattggagtcctcctcttgctgaatgactagttccagggatgctagagcgttccacacttcgtggtatcggtggggtagattactttgggggtccaaagcctcacccttgtgtcgctcaaggaggtgtctcccgaaggcagcgtcatatctctggactccgttctcgacagacctccaacccccgcgactatacttgctggctccgaagttagcaacttgtgccactgcatatagagccctcgggaacgcttcgaagatgattccaacatccaccttgccgctatcaagtttagcgcccggctcacccggcttgattccattaggatcgacctctactttattattagatgcagctgtagaactgaccacccttacaccccacactctttcgaattcgattaagcagtaggggcagccccgtgggcatacccccgcctcgtgatcctccaaccccttagataggagcgtcttcgtcatcgaacacctcgtcgaatacatcctcgggctcttcctcggtgaaggcaccaccgaacagcggatcgtcctcaccgtcaccaccggatacgatctcgtggagtcgtacaccgcgcagtcgcagggccgtcatacaccgcgcagtcgcagggccgtcatagtacccttgcctcgtgggcccttttgggtctcgatcaggatgccaacttcaccagtagagccaccccacgggttggggccatcatacggcttgttgtccgaggtcagaaccaccggcttcattacagcagacttccgctcaccatcttgcatccaatccacgtgcttcttctgcttgaccttgaacaggtactcgccgtcacgctcttggtacttgatggtacccttcagtcgggcatccttggactccatctgctgtaccagatcgtcggcctcttctttggtcggaatgcagatggttacttggtagacttcaccgtactcggtgtccggagttacgatgtaggggaagatcagcttcgctaccgggaaggtgaatcgttgggatactttcttagacatatcttaaacctctcgtagggaagaaggtattataccacaaagggggctgaaagtcaacccccagatgtatcagtgtgtgtcataccacgagcgaccagcgatggaatcactagccaaaggacagttaaccccaaggagaactccagcgtcccggacacagatttccatctgtccacgtagcgcaatgagatcctctgggtggcattcccactgaccttcgtcatggatatccaggactttccaagcccgaaggttcaacctccggacccgttcatctaggagcaccatggcccacttcatgacaattgcacctgccgcttgtaggagggtgttcaatgccttatggatcatcacgtcgccagactcagaacgtcgcatggttagcttccgtccgtctagcccttcgagataacctctctcggcttcctgcttaaccctctcaatcaatgcagcaagatcagggttagcctcaaggaactgggcccggagcctagccccgtctgccctggtgcctccaatgatagtcccgatcttggcatccccagcaccgtagatgaaggcgtagatgaacgtcttagcatcgtcacgggttgggagacctgcggctatctggttggccgtgtgtacatcaccctcgaccacctctttggtgtactctgggttattgatgtaggatgcaagcatccgaagctctagtccagcaccgtcatagcccacgaagatcatttgattcgctgggacgtatatcttgtgctttcctacaggcttccacttacctttcttgagttcctccacgatgttagtgaagggcctaaccctttcgttctctccaatgtctcggcggaggacagtccatttccattcaccggcatcaggtgtcccctggaacaaccctcggatttctggtccaaagggagaacgagcagcggggatattaactactacacggtgcctcattcggcccgtaggtgttgcacaggggttagcactcccctctaggcgtccatcgggcctcacctgatcgacaagcccctgcaagagggaccgccggtgggcccaaaccattcgctgcatcaccagctttcccaggtctccctggacggtatccatcgactcttccgtcatcttcggagtcgtcaatacctttcgttgcctttctaactttctcttgacctctccgatcgtagtcttcccagggatgatcccttggagcttcattcggagtcgtccagatttactctgtcggaggtcttcaatgtacttgttcaaggactcgttaaggtcggatccacgtagcttcttgccatcagtgccgacagtaatatccttgatgttccattggtcaggaacccatccctgatccagcatccaatccttgaacttggcagtcttaccaagatcgaagggtatgtactcgattgcagtgaagggtccagagacttcgaaatgcccaagacgctgccataaggactggagcctttggttcggcttaccactctttaggaatggcttgctgaaggccccagcctttacgatcatcatcggcatctgggggacggcctcaaggtcaatcttgaggattcgttcggtaagcacatggatcagccacttggcccgctgagtctggaagtagactccacgtttactctggcgactgatgatatcagctaccttgtgctcaacgaacagtgactttctccaatccacttagtcccccttaagacgctccgctagattctctatgactacctccacggcatcgttggagataccctccaggtaggagaggtagtccacggttccgcttcggtccagtcgccattgctgttccaagaacgctacagcaacttgcttgagcaggaagtcatctacccgctccatgagaacactcttgatcttgctcatgttatcaccagtcgaaaatgaagtaggaacacccacgctcacaggcaaggtccaccaggtaccaggacaggtcaagcttgcgctggatatccttggcatcgctcaactcttcgtcggacaggttgaagacaccaccccgcctcttcttaaggaattgaaacccccacttcttctcctcttgggaggtaagcaggacatcccgagggtccagctgggcgcccctgtccacgtagaagtcatcgtagaggctcatatccttgtcacgaatccgggcgtttcgacgatccgagtaggaactcaggttaagatgagagcctgtgaagtagctcacccccaggaatccctctggcaggctcaggaacacccgacgcttctcccgtagcgtaatgtggggactgctgaggaacttccggatgttagtcctttgtacctccatgctcttatgtagggcagaagccatattacacaggtacttaccacggacatgtttggagtagcttacatggtcactcatttgtatctcctataggggtaaagcaacccccggcaccttaaggttattatatcacactttgctggatttgtcaagactgtctgtggaaaactctgtcataccacttgtagaagtattgagcagaggtaatcccaatagcacctccccacccggacacgaagataaaccatccgatatccaagtgggaggaggctaccgccttgatgtaagcaaactgagccagtgtgatacaccaagacactacaaacccagccttaatcttgtcatcccgaaggagcttagagttcaaccccagtaggaatacctggaagaatgcactccagaagatgacaatcacttgtagggctattgacatgactcgcagacctctgggtctaggccacaggcactacccagggggaagtcatcagcatcgatctcggggccaccccagctaccagagaactccttctccagggcaatctccttccgtgcctgatcctccaggctttccttcttactcgccatcgttaatctcctccacagaaacccatccacggacagccccaacctcataggcccggacggtcaatgggttggcatcagaatcacccgagtagaaccgaatgatatccagttctattcgatagaagtccgcagtgaacaccttggtgtcctggaaccccacgttaacccgatacttcttcattcttacctcccagaagctcttcgagattagtcagtaccttctgggccttcaggttgtcctgcatgatctgggtacgctcagctttgagcaggctgatctcgttgtagatgcgctcagattcctccgaagactcttggatgaaggtcttcaggttcaccagaaccttatcgaaggaactgaggatgttactgatgctaagctttcgattgaacatagagagtcctcgggggcccgaaggcccctccttagttactttttcttacgaatgcctttggccttacgattgcccacccgaccaccatcagcagcgttagaagaatgactacggacgcggagattagaatccccgttaccgccaccatctttaacacgtttgatatgatcgacaacctcgtcggctccgagtttccttccaagacgcttttccacctttcggcgggctcggtgccgctgagcatctccagacttagacccaacgcccgtttcgccgcgtcgaatagccagttccctttcacgcttgtagttcctcactcgctttttagccaatctacagtcctccattcaacaagctcttgccaagtcatgccgagtacccggaggaggtagttgaacagtgcgtgactgaccactccatcctgaaggcaatactcaaacatttcttctgagaacttggagaagtcgttaaaatcacccttgtgacacttcaggaatctaccccaggcacccagggaatgaccctggggtcggtctggccaagtcaacctcgatgcaaccaaggtgtcgtagcttcgatctgggggtatgataatcccatgaagtttctcaaggacccggttgtcgtagtcaaggatgttgtgaccgactacgaactttgcatgggcgatgatcctgtagaacacatccatttcctcgggccggaatccccggactaccccagtcggaatgtctacaacaacagcgcaccaaagccttgtgaccgtattgaagaggctgtccccctcaaggtcatagatcacgtaatcaaattggggtgtcatcgtcagcaggtacctcgtcgtaactgccctcgcgctcaaccaagcgacccgtctcagggttatacttggtgaacactaggccagtgttaccgtagttcctgtccttgattacacggattcgactctcgtgcttctcttccccgtcagcctgcttgttccgctcgaagccgatcataagctgacaccaccgctgcatagctcgggaaccagtgaactggctttcctttacttcagctccctcctcgtgggtacggttacccttgggtgggttaaggtgggagaagatgaagatccgcagtcctagctcgtcggccatccctgcgagttctgtacagatacgggctatctccgtgttcatttcagaaggactaaggtggttggtcatggcggtcatgttatctaggaggatagtcttcacatccatggctacagcccagaagcgaatacactccttgatatgatcccaatcgttctgacccttattcttccacatgaagagcttgcctcggagtttaccagcagcatctttaaaggcttgctcatcccactcgatatccggtcggtggaagggcacgttggctaccttccccgcgatattcttaagtgtcatggctacctgctcttccaacaggaatgtccctacgttctccccgtgctcaatgcaattccaggcagcaatctcgtgggccaacagggtcttaccgataccagtaccaccgcctaccccgatgatttcaccatcccgctgaccataggttaggttggttaaaccttcccacgggtaactcttgccccacttggggggttccagagcctcagcgtatacctcatcgacagtaacggaacagtccggagacttgaccttgctgccgaaacgtatcatctggtaaacctcatccccccggttacgcataagcatgtcattagcgtccttcagaggaagctcgacaaacttacactcggggtacagggcacgtaccttttctactgacttacggccttcgtcgtccgcatcgtggcaatagatgacctcgttgaaccgctcaaggacaccagactccttaaggaatgcgatatctcgaccagcagaaccaacacccgaggaccagctaatggatgcctgacgaagatgcttccacttctccgggagtttcgactccatgatctgggccacagacatagccgacagttcatcttcgcagatgactaaccgcaggtggcccatatccttatgccgaagggtattatacccgaatgggtctacaccgcccttggggctcccacggtagtagaaggccttgggctctaggattcggacgttaaacgctcggtactccccatcgcgagtgcgtggatagtaatgctcgataacgtcctcaccattttcttgtgatagaccaacacgtaccccgtaccgttcagcgattgatttgctgatctttcgagtatcgagggctttagttggatactcaaggacttcgttgacttcatggatgatatcctcttcagatttctccctccgctctggtaccttgaaaccctcttcgaggatctcgtagtgaccacaacggttacaacttccgaaccgagtacccttttctgtatcaacgaacaagatgaggtgatttcctgttttatccccacctttagctcggcaacccggacaagccgtatcaccgatgattttcttcacttacccctccagttgactcttgagaaccaggcttggtacagcattcacgttgcccggtagggttttatagggagttgttacgaaggtaccgtagacttcctccagttcccgaagacgatcctcgattttcttcaatcgctcccacatgaagcgaatgccaatggattcgtcatagtacccaccgtagctggtctcgggactgtccgaggcctccggaatcttggagacctcgatggagtcttggaggtgtcgctgggaagctacaagtcccaggatctccttgaggagcatcttctgggcatgtagctcttggtgtccgaaggtgttcggggtgtcgcggtagacttctactgctttgtctacggtcatttcgttcattatactgctccttgtcgttttgccaggtgtgccttccagtcgccatccttgacgatatccatcgccatgtggctatcctgatggtacaccagggccttgattcgttccccattgattcggaaatccttgagggtacgatcataccaacccggataaccctctagggcatccaggttctccagcatttcatcccccgcctcaccctcggggagctgccagatttcacctacgatgaggtcagcacgagaggcgaaggataggatggggaagccgccagcggagtacatgagaccccgctcgcaggatacagcattgccgatgaactcggccccttccagaaggtagtggttgtacaaacctgacaggagagtaccataaacgaaaacacgaacagccattagatagtctcctcgaagattttgttgaagcctttgacgtaggcctccagtgcgctgccttcagcgtccagacctggggcggtgttgatctccaggacaaaggcccggccagtggaatgctggaagatgatatctactgcaccgaagtccagcccagccacctggattgcctcggcagccgcagacaatgcctgctctgcaccttcacggtcagccgcatcattcaccccatagacccaaccgccggctacgttacggacaatgctgttgccgttatcttcctcgccatcggcgcgacgacggagcttgacttgcaggaggactgcttccccacggatgacgtggactcggaactcggtacgcttaccgacgatgccctgggtgaacagttgtgccctggtaatcacttccgggatgtgggtttgaccgtagatgtgtaccgggtagtggccttgacggcgaaggttatcgattgcagtaacctcggcgtcgttgatcgaacacaccagatggataccacgaccgctatggccactcagatcagtacgtgcatacatacgaccagtgatattgaggacacccaaggcgtcttcccagcgctcggtccaacgaggaatcaggtggggagcattggcctcgaagtggcggaagaactccagcttgttagagcaacggtaaacatctgccgggtcgttgaggaacacaggggcgataccctggagtcggctagcctctgcaccaacggtcccccagttgattaccgcagtacccgcacgaccccgataggtagacccctcggagcgaaggattcgagcacccagggcgttacgaagggctacagcaccagcagaggggcgggcacctttatagatatagaacatggcaaatctcctgtttctgttgagggtagtgaagccagcaatagcccctggaatcctaagttagatcccatgtacgcatcttaggaaccggcatgggtcggccaggggctattactaacgcactaccttactcgaagtagtcttcgaagagtcggtcgatagcttccgcaatgactaccggggccggtaccaggaattcctcgtccgggttggcatcattgagttcctgctccttgactcgacgaatcgactggatcttgtccagggtgtcacgggagaagggatacttacgggttgcgtcggtctccatctggatcactacttgacgcttcatcgttacttgggtcattttgacctcctatttattttcgattacacactcaccacagatgaactcgcactcatccaggctaccagtgaacttggcaccttcgtataccgtcagatgacgattacgctggtcatatgcggttgggatcttcccgcaagatgcacatccctgggacacgaagtcccgaaagacatgcacgttgttgaaggtgtggccttgcaccttcagggggtaggtgatgttggccggaggggtgttccccgaggtgccgccgacttgaaccctgggtttagaatgggatttcgtctccgatgagatcgttccaatcctcaacactggggtagtctccccaggagtcggccgatgctttgggtccaggcagcttaccgccagatcctcgacagtaaccttaagatcacggtcttggccgatgaagtaggcattggagatactccctcggaggacggtgtatccgtggactttggcgacgttgatgccatgagcttcgatgagaaggttttcttcacgctcgattccagtgacagttccgtattcgctgccgtttgcgtaggcctcgatcttgacaacatcgaaggtgacaagctgccggtgcttgaaggtgctacctgctgcgtcgaggttgttgttgatccggagggtgttccttgcgtacgcatcgccagacgttccatacgacgagcccgcttggctgcctttcgttcccgctttgctgccttggcttcggctatagtcctcgtagtcggagacaccgacgtagcgaccccaccatgccgctgcttgcctttcgctttcggggatgggaaggtcgagaaatgtaaccggagtggtctggggttctgcaccctttcgcactccggcctccgtgaacgggatagttaccaggacttcagccttcagttcagcgatgggagaacgcaggcggatcttagcgttgggtcgctccaggaaaaccttgagcatcccaggctcagacgcccatacgatagtcccggtggtggtaaccgccatgaacagaggacgatcctcgttacggatgaagttcaggctacgttccttggagtcccaccagacaaccgcagcagcaccagagaacttctcctcgaacgtcttcttggcaccgtggttggcaatggtagcgcacagcatgttcgaatccacgttgtacttatcattgccatccagcaggtgcaggccccaagtatctacggtgccgttatgtaccatggtgatgtggtctacctggaaggggtgggcattcccatggtccgtcttgtcgcccatcgtggcgtaacggttgtgacccatgtagatgcgagcccgacccttgtccaggaactccttggtttcaggatcagccaggaagtcgtaggcatctactgcccgcttgtgaattcctacctcgttcttaaccgggtcgatcttggccaaaccggtggcgtgagcaccacggataatatccacggccaggagggatttgagaagagcgatttcgttatcactcgcgttagttgtggcacagaagcctaccaatccacacatcgtatttctccttagtacatatctggttcgattgttacgccggtatggcgctgaaggtgctgagggttatccatgagcgctacgaaggcatcttgaagaacctcttggtcctccagaaggtctcgtacacgcacttggtgaccaatacgacgcagagaggttaccgcagtgatcgctgtatccagtcgaacctgggtacctggcaccattgccaagttgtaccgctctgctgcaccatctagtagtcgtgaggtagtagcgcgagccaagagcagcctacgatccaagtcccgctggcgctcacgttcctgctcccggagacgacgctgacggttctgttcatcttccagaggatctaccccggagcgaacaaagcccatggttgctaccgcgagagtagcactggcgatccccatttcacgaccacccggagacatttcatagtccggagatacccccaggaagaacacatcacggagattcacctcggagagcaccttgaggaactcttccaggggggtttctgcgtgagccatggcgaaggccttgagacacaacatacgctgcatcaggcctaccatttcctgccgagtagtgagagcatgggccccacggaactcgatggacccgaagttgtgggttacctggaggttcaaggccgaatactttggccaggaggtaagacccaagactttctctcggtcaccttccggggccaggatacggcgaccgaaggtctgggccagccagtcgttgctgaagaacgggatgcagaagttactatcccgacgatacggttggcagtgatcgaagaaaacatcctcgaatgccatgtaagtcaggaccgttcgttcgtacaccggccactctacgtcccgcatatccatgtgcaggtgggtggagcaacggaaggtaggagccggaggggtttcttccatcgcacttacaaaggattcaacccgagtgattgccctctggccagaggcgggaccggagaagacatactccataccctcccgcagagagccgtcacccttcagatcccacccatccacttccggccagttgttgaggccttccagttcgacttcgaaaccgaaggaagcaaccgcaggcagttcctcgtggtgttccggggcaatgatctggttcttacggaaccctatctgtgtgccaataactgacatagcaagtcctcctggttcttgaattgttcatctgcggacagccgcccatccaccatctggccaaccttcactcccttccagtgtacaaccccatccttgatgaagaagtcccggtgggagggagcagagatcatttcctcggcctgggtgaagattcggatcatcatttcgccggtgatagcctgttggccatgattcagcaagatgttccggggatctacacccttgcgctgggtacggttgttcacgaggaaggatacataggtatcacgaaccccacgaccaaagacgtcatagtacccactggagggccgcacgctttctacctcgctgtagacaaccccaccgtagtagttactgccgtcggggcggtacacgttgccaaggagacgaaacccatcgaattgacggtcgtcaccaatggactcggtatcgtccacgtacactacccgaggctcgccgtcaacccggaagaaggcataggtggaggagtagtacatgttgaagtccacggccaaccgatggcgattattcaggtcattcatacttcacccccagcgcttgaagtgcagctaccgccgcagcgccgtcgttatcgttgatgattctctggacttcatcgccagatacgatggatttgtactcctccaggaggtgcttggaggtgtaggcttgcactgccatttcatagacccactcggtcagatcgacagagaagatccagaagttcgacaggctacggtactcgccgccgtagggcttatagcgcattgcaccagccttgccgtacagcttcttacgctgggtgtcaccgtcgaggatgacagaggccaggcccaggaggtagtcacacatctgcatgacctcgcgggtgttcgccttggtgactcgctcgatgtggctgaagccgatatggacgtggccgccagcagtgcgcagggtcggaggggcatccttcggcatcacgttctgacgacgagtccagcagttgtagtccggctcgcaaccgaagacgtaagcctggggaccgaagctgcggaggagttcctcgtcgtacaggtgagaggacaggttctcgatgatgttcatgccgaaggggtggagcatctgggcacccaggagtcgaacggaaacgatacgcttcacgaactcttccttggtgctggccgggtcgatgttgtactccagaagaacgttgtcttcctggacggcaccaccggctacagccaagggagcttccttggttccaccgatgaagccgatgacgctctgggggttacggtcgtagccgacgaaaacttcgggatctgcaccgatcagggggattgcgttgttcattgcatagtctccagtttttcgaggatttcggggatgctgtagggactggtgggtacgacctcggacctttcccgacctggggcacctacatcaatggtgattggggccatgatggaaaggattcggtcattaggtacaccttcgagaccgtcgcattcgatcaggtaatcatccttggtatacccctgccacaactcagcgtcgtgatgcttgagcttgtccttgaactcttcgcgagtccgctcatggatgctcttaatatcgaagtaggtgatattcttgtatccacctacgataccatccatgacctcgcttatgtagctgtcatccacctcccagccgtggctctcgcattcctcccggtattcaccagcagtcaccgggaacatggccgggtggctgtcgcaatgagcagtgctacctacctgggcacaagccgcgagggtgaggatctctgcattgcatcccaggaccttatcccggttttcctgggtatagcgacgcatggaatcacctacacaccacaagcgatcgcccattcggagggcacagatgatggccgatgcgttcttcctgaggtccacccgtacatacactgcctgccggcgtcctgggggagagaagtggtcgggatcacttaggttcttgaggtcatcgttgtaatcccaccaacgggtaggccagtcgatggaagccgagagaataccaccgtcggtaatcctgttgaccagatcgctgttcaagaactccaccagtttaccagaggtattctcgtgggtagataccagcaggtggccaaccccggtaacccactcacctcttataccgccgtaggtctggtcgcaataggccccgaagcagtttgtatattcggccatcatcttgaccgagtattggtgtacaacagagccctcggcgtcatagtacacattatgggctgcatacattcccatttgatttctccttggttgtcagaagtttttctctatgaatccttccagggcaagggggatatcccttgagccgcgaccccagtgaatttcacccataatccccagcattaccactccgtgtttttcacagctagtgggagtaagccgtaggaaccctcccacctcgctatctacggtcgtgtagggatctttctttccgaagacggttggctgagggcctatggtaaccacctccaccttgtccaactgaatcttcaggaattcagaccgccagggtgtactccttacccactcacgtccacctggggcatcccgattggccatccaacgaccgaatcgcatagactcttcagcggattggatgtggatatcccccttcttgagatcatcccaatcgctactgaacatgtagttggagagggggtacccggtgtagccattggctatcaatccgtggaaggacattgcgaggtaggacttccagaagccatacttctcagcaagcttcaggtgaatcccctcttcacgaccttgggggtcgagtccgctggatatcatcttgaagaggaacttcatgatgggataccaggaatccagggtgtgtaccttcggattgaagtagattccgcagaccccctcctttccatgattgttgggactaaccatttccgtcccgttagaatacttctcgaagggggaattcttggccttgctttcgtaagaccagaagtgaaccttcgggatcttgaaggccttgccgccgatggtgatggtcttgagttcaccttgggtacacttgttgagtacatcgatgaacttcttgcttcggcgggagcagatgaaggtccaaccgtcgagcttatagccgtaggttaccgggccttccatggtaccgaagcaggaggcagaggtcattaccttgagagctttatcctcacccttcttggacttcataccgaaggcatacttgatacgggccatttgttttctccttggttgagttagccagcaatacccccaggacaggaatactaggggtattactagcgacctctaagttacttagaaggcgccacggcgctgctgcttacccttgtggggagcaggaaccttggtggccttgtagatgccgccattcagggtcagctcgccggaggttttcagtcgctcgtagaagactttggctttcataggcttcatccttgctggtgatgaggggagtaaggaaggccatacacaggctgatgaagaggactaccagcaggaggtagtatacccaatcatcatcaggtggcctcttgggggatccagcgattgctgggatattatggatagcgtcgtatatgtccgaagttacctcactggtacggtaacaccggcggtgcccttgggtgcggtccccattgctgttcgtcatagtacatcagacctccaccgtaggaatctcgattgggataaccatgaggtctccgaacaaatccttgatcctgttggacgaatccttcacggccacctcgtagttattaatcatggccttcgccgaggatagggtaggggttttgcaccaagggatacccccttgatagatgtagcaaacattctggtaaacaaacaccatgtgcctgccaatctccaccttctttttgaagacccctactgatccatcactgcaacccttggtcactatcatgctacacctcgaccgtgaagacgtgacccttgggaagtaactcgaagatatactctacccgaccgggttgaatgtcccaactgttgccagtctccaggcagatgaaggggagtgtctcggtgtcaaggttcagtctgcctgacacgaagattcgaccaccacctcggtgacgccagaagtgagggactacttcttgggttgtacgaacctttacttcatttttcagtcctgccaattcatcacgaagctcctggatctccatttccattcctccgcactgatggcgagcatcatcacccttcgctgctgcgtcgagtgccatagccaacgacttctccaattcctggatcttggccgtggctacctccagacgcttagcgtactcgtcgcggtcatacatgacctgcatgaacttctcgaaactgacgatgggtttctccgactcactcatcatctacccccaggggctttacccttttctccaggcgcttgctgtagttgtacagatacttcaggaagaagagcccgtagaagatggaggccaccatcagaccagcacccagggcgctagccgaggttgaatccgaggtcatcaggtaggggaggatcaggaggtagaggatccacagggggattgccaccagcatagtccgggtatacagcttgagcatttgatacctcacataataagtaagatataaggtagggcctaaggtatcctataggtataagagcaacccccggcaccttaaggttattataccacacttccagcagaatgtcaaggcctagatgttacagacctttacagagcttgtcgaggtactccgagtgctcgacggtaccggggtagtcctgcaacccaccgtacatacggcggagaaccccatggttgatgaggatatctgccgcagccttcacgttgatgacgtggacccggaccttggtcgagtggttgtcgctggatgcccaggggttgtagtggctgcccatgcggcggaggatggtatctgctaccacctgctcgctgttcaccgtgaagaccatcgtaccgtggccctcgttggactcacgacggattgcgccgatcagttcctgggcgaaacctcgggggctgaacccgttggatgcgatgccggcgtggtggtcagcggtacccgagggtcccatgccgatgtagatttttgaggtacagcaagagggaaaatctctgcgttgcattagtaatctcctttgattagtcgtttggttgacttgatgagggtgaccagggggcagtagatgacagccataaagcacatccagggaagtgatgcaggccacagtgcacccattacgattgcaatgtcccgatctctctggctcatcatcccgttctggtcgttcagaaagagtgcggaaaccccggatatcaagagggctaccgacatgtaggccaggatcgctgggattatcaggaggtatgtcatcatttgctgcggaccaccttccgatgtacgtcaccgcagcgatcacacctcaggtcgtaatagtggcagagttccactaaccgccccttgtgacgaatctcgtagggtccaccatcaagtatcttgtaccgatggacacccaagaggcaccaaagattaccgagatccatcaccaatccctcgcgcagttgcaacaacgaccctctttggggccgaagactggcatacagtggggacaaggctcaccggattggatcatagcctccctggcgtgccgcaggtaagccgatcggctggactccatacctacggcagccaaggtgaaaccaagctcaccacggggctcctgggtgccttcctggaggctcatgttaaacccccgcttttctacacgacgcttcatgcggcgctcctgggccattatctggccgatcattggtttattcttcatacggtccccacaccttggcggatacatggacctccttagccgggtagagttccccgatgttgggcatggtctgggcttcgaggatgctgaacccgctctggctgaggacgacaaccttattaccttccttgaggaagacaatatcgccagagtttttagggttcacataaaccccatccgcccgcttactgatgtgaaggtcgttccgggggcgggttgctgctacagtgaaggtggtgtttgacatggttgcacctcagtggacccgatgaaccttgtggtccaccggaatgccgagttcgtaaagggtttcggtgatgaactggccgaagttgatgaccttgaggtggaattcaccatcggcgctagccagccaatagacttggggttcagtggatttcatagacgatacctgcacgtttgccgaagatcgacacacggatatgagtaacagaccagttagggtacagcttggggttaggctggaacctgcggatactgaccaaggattccaaccagaggagcagatacagggcgggcgtcatagtacacctacctcacgatgcaaaagggatgctgtccaaggtcgaggacaggacgaagagaaccacccacgctaccagcaacaacccattggaacgtgagcgtatggcggcacatgcaatatacttccatgccatcaccgcgccctgttcttagccaaggatgcacgcttggcacgaagcttgttaagctccagggttttaccaaggtggctaccattggtattggtaagctcacgagttaccttggcaatcttgcggtcgatagcctcgatggcttgcatgttgcggcttaccttgcgatagtcgttgcgtttcacgggatagtttcctttgttgatttcccaagactccccagcctgcaaccataggcccggtgggggtttcggccaggaatcaccatggcctcatcagttgggtcagttgatacccatctcttccttccagtcacggaagaagaagtaaccgatgcctacacaagacaccacgatagcaataatcatcgcttcaacctcttaatcaattcttgctgttcttgcttccacctgggatcgggatggacccgaagcatcctagtgagcttctgcaaccgattaaccattagtgccctttcgtgggcggcttcgtagggggacttcattcggtccacccgcagaggcccatgcaacggccttccacatagacaccacaggcgaatttaccattgacgaaagcccaacggtaaaccacctgttcaaccccattgctattgtacgaacgggagttacaacgcccttgcacgtaatcgtttgtaacagctaccagaaagctaccaaaaggggcccacacggttttatcctcggttagttcatccatacaatacacggacctaccatgtactctagggatgaaccaggggcgcgtcatagtacgcccccgtccatcataggcaatgcctttcagcgtatcgcttggccctagatacctgcccacggtttaccatggacagatactttcggattcgttgctggtgaggggtgcgcttagtaaccttggggaagaaccaagcgccacccactactcgcatcaggccgcctcgccgttggggaacatctggcgcagcagggtattcagctgattcacttggtcagcagttaccttggactggtccttgaactcgctgtccagttccttgttgcagtccttgaccagccgcaggagccgtgcctggagatcgatcggcttgaaattgtcagcggtttccgccgggccgcagtcggaccagtgggtgttcaggatgccggagaacaacgccagatcctcctcggtttcaccctggcgaacacccttgtgctgtttgttgccgtcgaacttgaactctttcttgagttcggaccacttgaccggtgcgtagcgctcgaagtagcggcgcaggctgttggtcttagcgcccttcggcatcatggccagcatcgcacggatagcccgaacatcaccatgctcgtgagccagtacggtagccgaggccgccagttgttgggtcgcttcgttccaagccttgttgaacgatttcagagctaccagaccagcggtgatctgatccttgccgaggattttgtctgcggtgagtacagttttcataagtatttccttttgtttcaggagttaaggagaatgtcaagggggttacgccccagacgtgggctaccaaagaccgacttccgattgttgcgatggatatcagttttagcagtcttgcgaccgcctttgtatactgcggtcctttgtttcggtttgcctttcactttaattccctctagaggatacattgcaaagggttagtcctttgtaatatatcctacctaactccgaggttacttgtaagagggagccggatggctatcgtagggagtaaccttacctgttaggtagggatgcgtcttgcccaaaggactctcgcataccagtcacgataagctagtagtagggactcggatggctacccttttgacccaacctttttcaatagtctaaccgccgttcctgggtccgcaatcaagcgggttatcctgggggattggttagacctaagatactcggttgttgaatggtctagcttaaactatcggcattccccaatgcctgccctaccagggggcttgtatctcagctatccgtagatggctggggacgggtgcctatgttagagccttaggcttggcttgtcaatatcgcgctttatagtctctcgacttgttgcttagtggtccgtctgtatttacgtggtggaccaatcctatcggctagagtcatagctttgtagttaggatataaacaaggcgccctatctacaccgccccggatcaacacatccgctatgggtgcccatcgtaccgactgagccttaccttgtcaagtggtgccggtcatctgtttgaccgcgccgtaatcccttcacagtgtgtacatcgggaccacttgacaaacatgttacacttacctttaccgcttgtcaaccccggtcagctctcaactgtcgcggatcaacgtgctggcgtccttgtaccagctcaggggagattcagggttatacagcctcccggcccttgcgcctagccgccgtgtcgctctaggtggtgccactgtaattcacttgctatcccttgtcaacccccgatgcctgccggccttacacttgggtgacttgggcgatcttccctggttggcagcccccggatagcactgcggcaagggggatggtggcctaggtagaacgtgggggccattagacccggttccgcggggtttgtcaagcccctcggggtttcccccggtgcctatcggtttccctcaaggcggcgccattacgccatattctttacggggttgtctactggtttttcatacagtctaaggactatcagtcccccagcaaacccccggatatagacagtctttgattaacatagggtatcgtgggatgtcaataggggatcaaggggttatcaagggatattccccccgatccaccccctgaataccctaagatttttcttatgaataccctaaggtccacccgatgaacggtatctcaaggggttgacccccggactagccttatggtatcctagggaggggctaggggctatagccctagggataggccacccccactttatctgggggactcctgggggg

SEQ ID NO: 13 - DNA, 45538 bp, artificial sequence
  BP1662
atattccccagatacaccggaggataaaatagacttttggggtatcccccggttataggccctggatcaaagcacccttcgatacctgttggtatattactggataaaggggcaataggccaggacatagcaaacagaggtagacttaaggtatacctatagaacctggatcaagggaaccctatgccacttacccttaccagcaacctacgaagggtagtcttagggtatacctatagaaccctatcataccgttcgtcgggtaaatcatgtgattatcaaagaaatatcaaaaagtacttgacaaggtatccaaaatgtagtataatagacctataggctcttaagattccttcttccttttgacttacttactaagaaggttagttatcctaagattatcttaagatagtcttaagaacccctttcccattccagcaaaaaccctaacaaatccgggtcttgcgactaaaaataaaaaaagatgaaaaaggggcttgacaaaatagaaaaagtgtgatataatagtattataaggttgagaaattaaccttaagagttcattgggatgtagctcagttggtagagcagggagctgttaactctcaggtcgtaggttcgagccctaccgtcccagccattatggcccattaactcagcggttagagtgctcccctgtctagggagaagccgtcggttcgaatccgacatgggtcgccaacaaaggtcgttgtagaggtagatggctactaccatccggctgtaacccggacgccataggctagaggttcaattccttccttcgaccaccattaactcctcgtagctcagttggttagagtgcctgtcttggacacaggaggtcgtaggttcgagtcctaccggggtgaccatttagagagatcggagcagtgtatgtcagacgaaaaggttgtctcgattggggctgctcctctttctgctaaagaaaagctagacctctattgtgaggctctggcagatggtatgaataaaaccaaagcgtatatagccgctgggttctctcctaatcacgctcaacgcaacgttgctgcataccatcgaaagcatgccgaatacatcaacgcctttatctctgagcgcatcgggagtcatgtccctatggcgcttcgtgtggttgtagagatcgctagcaacccagaagagaaaggtgggattcgcctcaaggcggcccaggatatcctggatcgtgggggcttcggagctaagcagaaactggagcttactactaagaatgtggaagatatgtccgcagaggatctaatcagtgaagttcgacgaattctcgacgaagagccagagttggctaaagtcatttctttcccaaccgcttaagtaccttgatttaatcaagcgaagagaagggttggtactaaagtggtacaaagactccctcgggaaagtaactggtggttatggccacttgcaactccctggggaagacggaccgattaccctagcacgagcagagacttggctagagaaggatagtaaggcagcctatgatgcagcccaagggcaagtatctcagctgcctttttgcactccagagctattcgatgccctcgttagcgtcaacttccagctgggtacagcgtggacgaagaagttccccaagacgtggaatctcctgaagtccggaaggtttgacgaggctgcatgggaggcagaagatagcctctgggctaaacaaactccagtgcgcgtaagggacctccaacgggccctgtggcgtgcatcaacagtaggtgacaaggtggtctaatggatacccaagagcggctacggaatctagtcagggagctagctgagcggcagaagtatttccgcatgaaccagtacactccttatgggtggcaagagaagtttatcgcagcttcctcgaactgcgcccagttgctggctatgactggtaaccgctgtggtaaaacctacaccggggcctttatcatggcctgccacctaaccggtcgttaccctgagtggtggactggtagaaagtatgatcgtccagtgaactgctgggcggcggggatctccacggataccactcgggatattcttcagtcagaactactaggtgactggaagaaccctgaggctttcggaacggggatgatccccaaggaagatatcgtagagacgattcgtagggaaggtaaacccggatgtgtgcaagcagtagttgttaagcatgcctccgggggcctctcgtccctcatattcaagtcctacgaaatgtcccaggacaaattcatgggtaccgccatcgacgtcatctggctcgatgaggaatgccccaaggatatttatacccagtgtgtaacccgaacggctactactgggggtattgtatatctgacgtttaccccagagcatggtctgacggagatcgtcaaggacttcctccaggatcttaaacctggtcagttccttgtccatgcaagctgggaagacgctccacacctcagtccagaagttaaagagcagctactctcggtatactctccagcagaacgcaggatgagggccgagggtgttcctatgctcggatctggtgtagtcttccccattctggaagagaagtttgtatgtgagcctttccagatccccgatcacttccataggatcatcggtatcgacctcgggtttgaccaccctaacgctatcgcctgtgtggcctgggaccctgagaaagacaaatactacctctatgatgagagaagtgagagtggtgagacccttgggatgcacgctgatgctatctacctgaagggtggtcaccagatcccggtagttgttccccatgatgcctttaagcatgatggagcaacctctggtcgtagattcgtagaccttcttaaagatgaccacaacctcaacgtagtgtatgaaccgttcagcaacccaccgggtcctgatggtaaacacggaggtaactctgtagagttcggtgttaactggatgttgacccgtatggagaatggtgatctgaaggtgtttaatacgtgtacgaacttcctaaaagaaatgaaaatgtaccaccgaaaggacggaaagattatcgacagaaacgacgatatgatctccgctacccggtatgccctgttgatggcttcccggcatgcacgtcctggtgctgtacgaaacagtggatactacaggagtgatactgcaaagttgacccctgattggtttgggagtattgtctaatggctaagcgtcgtcgcaagattaagcctatggatgatgaacaggtacttcgtcatctagaccaacttgttaacgacgcccttgatttcaactcttcggaactctccaagcagcgatctgaggccctgaagtactacttcggagagcccttcggtaacgagcgacctgggaagtccgcgattgtatctagggacgttcaagagactgtagactggattatgccttctcttatgaaggtattcacgtcaggcggtcaagtagttaagtatgaacctcagactgccgaggatgttgaacaggcagagcaagagactgagtatgtgaactacctcttcatgcgtaagaacgaggggttcaaggtaatgttcgattggttccaagacactctgatgatgaagacaggtgttgtaaaggtctatgtagaagaggtcctgaaccctaccttcgaacgattctctggtctctctgaggaaatggtagcggatatcctggctgatccagacactgagattctagcacagagtgtggacgaggatggaacctacagtattaaaattcgcaaggacaagaagaagcgagagattaaagtcacctgtatcaagcctgagaacttcctggttgatcggttggctacctgcattgatgatgcacgcttcctctgtcaccgtgagaagtataccgtaagtgacctgaggctcttgggtgttcccgaggatgtactagatgagcttccatacgatgagtatgaattctctgatagtcagccagaaaggttggtacgtgataacttcgatatgactggccaactccagtacaactctggggatgatgccgaggctaaccgtgaggtatgggcctctgagtgctacacccttctggacgtagatggggatggtatctctgagcttcgccgtattctgtatgtaggcgactatattatcagcaacgagccttgggattgccgtcctttcgctgatctgaatgcctatcgaattgcccataagttccacgggatgagtgtctacgataagatccgagacattcaagagatccgttcggtactcatgcgcaacatcatggacaacatctaccggactaaccaaggtcgatctgtagtcttggatggtcaggttaacctcgaagacttgctgactaatgaggcagcgggtatcgttcgggttaaggccatgaactctatcatgcccctagagacccctcagttgtctggggaagtctatggtatgctggatcgacttgaggcagacaggggtaagcggacaggtatcactgaccgtacccgaggtctagatcaaaataccctacactctaaccaagcggctatgagtgtgaaccagttgatgactgcggctgagcaacagattgacctgattgcccggatgttcgcagagactggtgttaaacgtttgttccaacttctgcatgaccatgccattaagtaccagaaccaggaagaggtcttccagctacgaggcaagtgggttgctattaaccctgccaactggcgagaaagatccgacctgacggttaccgttggtattggtaacatgaacaaagaccagcagatgctccacctgatgcgtatctgggaaatggcccaggctgtagtcgggggtggtggtctgggggtcctagtctctgagcagaacctttacaatatccttaaggaagtcacagagaacgctgggtacaaagacccggatcgcttctggactaacccggattctcctgaagctcaacgggctaaggccatcagagagcagaaggaagcacaacctaaacctgaagatatcaaagcccaagctgatgcccaacgtgcccaatcggacgccttggctaagcaagcggaggcccagatgaagcaggtagaggctcagatccgactggctgagatcgaactgaagaagcaagaagctgtccttcagcagagagaaatggcccttaaggaagcggaactacaacttgagcgtgatcgtttcacttgggaacgggctcgtaacgaagcggagtatcatcttgaggctactcaggctcgggctgcttatatcggagacggtaaagtacctgagactaagaagcccgctaaggcagtgaggaaataaccttgggagaacgttttggctatagtctagtgctgtctgatgcggcacaacagatggtacgtgagaacgttcttcctgagcttttccgtattgtccaagaagagattgagggagagtggaagtctacggcacctaaggattcagaatccagggaggccatctatcatgaactccacgccctcaaccgcgtacaacttcgtattcaggctatcctggattcgatcactctaaaggagtataagtaatggaccttgagaatcaaggcatggatgaattcgaggcagcggaagccttcggagatttgctcggtgatgacctcctggcccccggtgatgaaaccgtagatggtaaggtcgttggagaggaagaagaggaagaggtagtagacgagggtactccagaggacaccgaagaggttgagtccgaggaggaagaagagtctgaaggagagtccgagggtgatacccccgaggaagatccagaggatagactcttcgagatcccgattggggatgaagtctacgaggttaacttcgaagagcttaagagtggctaccttcgcaatgaagagtttgtaactcgacaggctgaactagaggatcagtatgcggctaaattcgaagagcttgatgctgaacgctctaatctactggccgagcttgagcagtacgctgttaccgctattgctggtgctaatcagtatgacaatgtaaactgggagcagcttaaggcccaggacccagagaagtatcaaacccttcgactggaagccctggaagcccgagatcgagcccaggctcttatcaaacgccgtaacgacattaaggctatgcaagagaagcgagccgagattgtccactctgcctacgttaagcgtcagacagagctagccaagaagcttatcccggaaatgactacggatgagtcttggggtgacaagattgtgtcctatggcaaatcgattggatactccgaggatgagatccgagggatatctgatgcccgccaactggctgtacttgatgcagcacgtaagtgggctgaatctcaggtccgtcgcaaggctgccctagagaagaaggaggagactgaactacctgccgcagttaagcctgctgctcgtagggcggaagcctcagagggttctaagcgggttaaagctgcccgcgctaatctgaggaaagatcagtcggttgaagccgctgctgctctcttctcctctctcgatattttctaatagaaggaaacgtaacttatggcaactccaactaatgccgtctcgactgtagagatcaacggtaagcgcgaagaccttatcgatatcatctacaacatcgcaccctatgacaccccattcatgactgctatcggcaagggcgtagctaccgctatcacccacgagtggcagactgatgaactccgccagccgggtaagaacacccgagttgaaggtgaggatgcaaccatcaaggctggtagcttcaccaccatgttgaacaactactgccaaatctcggacgagaccctgcaagtaaccggtaccgcagataaggtcaagaaggctggtcgtaagaacgaactggcgtatcagctggctaagaagtcgaaggaactgaagctggacatggaatacgccatggtcggtgcccctcaggctaagatccagcgtaacaccactactccgggtcagatggcaaacatctttgcctactacaagaccaacggttcggtaggtgctaatggtaccctgccaactggtgatggttccgacactggtaccgctggtgacctccgtcttctgaccgaagacatgctcctgaatgcctctgaggccatctggcgcaacggtggtcaggctaactcgatccagacttcgagctcgatcaagaaggccatcagcaagaacatgaagggtcgtgcaactgagatcaccctggatgcctcggacaaccgcattgcgcaaaccgtggacgtctacgagagtgacttcggtaagtacaccattcgtgccaaccgctggttccacgaaaacaccatgttcatctttgatccgaagatgcacgccctctgctacctgcgtccgttcttccagcacgaactggctaagaccggtgacagcgagaagcgccaactgctggttgaatacaccctgcgtgttaacaacgagaagtccggtgctctgatccgtgacgtcgtagcccaggtctaacccaacggggcccttcggggccctttgtttccccttaggaggtacatcatgagtatccaatcgacttatgcaattgacgaagaccttgggctctttatccgaaaggatactcaagatgttgagtcaatcctgtccgctaacgccgaagagcgccactcgggtgtcaatagcaaccgcaaggataatatgcgcaaggtagcaagtatccccctggttgtcgtagaggcactacggaatcgtcccatggctgaaggtggtcctatcgatctaaacctgattggttgtgacccagatcatgccgcaagatttacccgttggcttaatgaccgagataactatcggatgcggacctctgaggcacgggtgtaatgaatggctacgatcaataacgtaactgatctcgctattgctgctatccagtggtctgaccgtcaggatcttacccaagaacttctgatgttgttcattgggaacactactgaccgtcttaaccgattgctacgagtgagggagaacgaacacttcgaaactctcatggccttcggtggtggcattgagatccctgagcactttgttgctctaaggtctatcacgggtgactcccttatcggtggacgtactcttcagtacatcacccaggataccttcacccattatgttaactacaactaccaacctcagggtgtaacctactacactcggttgggtaacttctggagagtattccccgttgttcctgacggtgccccgttcattgttaactactggactgtactcccagagctaagcctcgctaacccaacgacttgggctctgacgaagtatccgcagatttatctctatggtgtccttgagcagatttatctgtacaccatggatgaagctcggtcccagttctggggtcagaaactcgaacgggctgttatggaactccagaacgaggagaatgccgctgacttcgctagcactcgactggcgatcaaagacattgaacgttaaggagattcagatgcctatctttctaaaaaccctcgcaatcaaccttctggctaccctcttcccaaccaaggtaatcgctaagtccatcgtgactggtgctaaggctctggcggagaagactaactctaaggttgacgacgagttcgtaaaagtcctggaagacaaccttaaggagaagacggaggatgcaacttctaactgataacctgggcagcatcgtcagtgccctggtcgtatcctcggtagtgacggtaggttcctcggttgtcggtcagaatgttaatcaggctctgcttgaaagaaacatccaggccacggagaagctcacccaagcggtgagcgatctccagatttctatggcaatctttggggagcggtatgtcacccgaaaagaaatgaaagaagagataaaggaggccaagaatgggtcttgaggtcgcaacttacattaaccagttggtgcctacgaaccctaccggctctgatctgaaatcctttggggatgaccacctgcgtctcattaagagtgctattaagaacaccttccccaatatttctcaggctgtcactgtaacggcagcccagctaaacgcagtcgctgatacaacccagtatgttaaacctgggatggttatcatgtgggctgggtcactagctcagatcccagcaggttggaagttgtgcaatggggtaggtactacctctaacgggattcccgtccctaacctgattggtgcattcccttggggtatcaatggttcttcccaggctgtagggactagaggtggtagcgctaacatcgtatgggatgggttcactgaagggactgcccttaccctagcccaaatcccatcgcacacccacacttggagatccagaggggctactaccctcaccggttctgcgggtgactctggtgctctgacgggtggctctggtaacgcagccaataccaaccttgagactggccctgctggtcaaggtcagactcacaaccatgcagtaaagatcaacatgccgttgggtaatatcccaccgttctgttctgtgttcttcatcattaagaactgaggtatacaatggccctagagagacaagaggtcaagaaccctacggggattgtgaccgatatcgcccccgctgacctgccactggagaaatggtccttcgggaacaacgtccggtttaagaacggcaaggctcagaaggctctgggccatacgcctatctttgatacagcccaggccccaatcttggatatgttccctttcatccggaataacatcccctattggctcctgtgttctgaacaacggttgtatctagccgacgggactacaatcatcgatgtatccccaggaccttacgctgctagtataactaataggtggtctgtaggatcattcaatggggtaatctttgctaacgatggggttaaccctcctcatcatcttccaccgtcagaatcaacctttggggtacttcctaacttcccagcgaatactacttttaagaggcttaagtcttttaagaacttcctggttggcttaaacgctacaagtaactctgtagaaatgccacagatggtctggtggagtacctcggctgatgctggtggtgtacctgcatcttgggacccaacggaccctactaaagatgctggtcagaacaccttggctgataccaatggtgctatcgtggatggtgtgaagcttcgtgactccttcatcatctacaaggaagactctgtatactccatgcggtatatcggtggattgttcatcttccagttccagcagttgtttaacgacgtaggtatcctcgggcccaactgtgcagtagagttcgatggtaaccactttgtagtaggtcacggtgatgtatatgtccacaacggtgttcagaagcagtctgttattgatgcccaggtccgtaagttcttcttctcggatattaaccctgacaactatcaacggacattcgtacttgcagaccacgtgaatactgaaatgtgggtatgctactcttccactaggtctgagccaggtaagcactgcgacagggctatcatctggaactggaaggaaaatacttggagtatccgagaccttcccaacgttctcagtggagcctacgggatcatcgatcctaaggtgtctaacctctgggatgacgaccccaacccctgggataccgatacttcggtctggggtgaaggctcttataacccagcaaaatccagtatgatcttctcgtctttccaggataagaagttgttcctcttcggtaataactctacattctctggacagaacttcgtcagtacccttgagagatccgatatctatctcggggatgatcgaatgatgaagacagtgagtgccatcattccacacattactggtaacggtacttgtaacatctgggtgggtaacgctcaggtacaaggttctggtattcgatggaaaggcccttacccataccggattggtcaggactataagattgacactaaacatgtgggccggtatatagccttgaagttcgacttctcttcggagggtgactggtacttcaatggatacactattgaaatggccccgaaggcaggtatgcgatgagtcaaaagtacagcccttcaattccaccacaggaagaggaggaactgctgcccttccttaatgaagaattcgttagggttggacagactcttaatgacctagctgacggctactggggggtctctatggagccccctaagaagctcaagccagggactgtaaagtattttgcccccggagtggtaggtccagtatccggcatctatcattacgatttggacaaccaatggagactcgcaggtactaaacccaaggacctgccgggggattttatcctatttactccacagaataaccaccaaccgatgggcacttgtgcttaccggatgaatactgctaaagacgaagtgtggatcaccatgcttatgtcaggaggtaactataccaacggggctacagtcctagacttgcctcaggcgtattggccacctgctgagttgtttatccctgcttactccagcatcatcccagcgcagagcactattacttatccacctccgtctgaccctaacgcacctccgttggatcaagtctttgatgttctcaacagggctactattcagactggggtggttaaccaagcaatgtttaagatcacagctaatggccgtgttctaatccaaggaattccccaaggagcagtcttcgggggtacattcacattccccctggtggtgactccatgattcatttgattactcgtgagaatatcgatctgcttcctaccgtagtccctgctctggcccgagccttcaataggacggacctcggtaagttttgggacttcgaacacttggttcactccttggttaattatgaggcctatgtcttctaccaggaagagagtggctacgctggtgtaattcaagtgtcccaagcacccctgggtaacatccttcacttcttctggagtggtaagatgcctgggaatgaaaccccggtagattactcggaggtagacgacttcctcggacagttcgcccaacgagttaactgtcggtttatccaatgtgaaggtcgtcggggctggaagcctacccttgagaaactcgggtacaccgaagactccgtttccttctatcgtgaggtaactccagatgaacttcctccaatttaatgtaaagcgtctgatggggttcgatgtagaggatgccctagattctcgggcttataagggtggtagtaagaagcaaaagaccacctctgtctctacaccctatcagcaaggtaactacaatgaactactctcgggtgccagtgattggctacataacgggggctttgaccctaactacggtggcgatccgaacttcgacccggtggctgaccaaaatgctctccagcttagtggcatcgaagggctgggtggtctcgggggtgcccttcagtctctcctgggtagctcaggtgttagctctctggctgattaccttggtccttacgatcccaataaaactggcttggcgaacgccattggtgcagccaacgagcagatgcaatgggacttcgacactacggtacgtccagacctgcgtgcaggggccactaatgctggtcagtatgggagttcccgagcgggtgtagcagaaggtattgctaccgctagattgctccagaatcaacagaataacgcctcccagttggctttccaagaccagcaggcttacaaccagaataggttgaataccctgggtaacctgtcggctattgctaagggcctcggctctggtaatgccatgcaggtagatgctggtagcatgcttcagaaccaggagcagcaggaaatcaacggggctctacagaagtgggcctatgagaataacgtcagcctcaacgacctcctcgcctacaaggagcttatctccggtgacatgggtggaaccaacgttactacctcctcgggtggtggcggtggtggtggcctcgggtctgccctgggtgctctcggtggtgcttccttgggtgctctcttcggtggcccagcgggcgcttctgttggtatgaatgctggtggtagggtcgggggccttctgttctaatgacctcccttcctcagaagctgttcgctataggacagaatataggtggtgggcaggagcgggtacagttgagccgtcaaggttcctaccgccccacccaccttgggacaatgcaatcgggagagtctagtggacaatcaaacccttttggcgcaatgggcggagcagcactcgcggctctcctcgggaaaggaagtgagccttcttcagaaacagtaccaagcttttctgtcgagggggctagaggagcaagcgaacgaggcgcagcggaagttgcagcaggtatgggagcgggagtgggaatccttcctagcgcagaagagctcggtttcggacagcaacccaagtctggaatcctaagtaaactatttggaggttaatcctatggccagcatggcttatgaagggtccccaattcgccctagcatccttcgggctgctcagaatgaactggacatggcgcgaatcgcaaggaacaaactgccgctggctgtagagggctcaggtattcctgatcgtgtccgtcgtgctgctcaggcagccctggagaatccagagcgttggtcccgtgcagcccaagaggttgcacctgcggctgaagctactggtcgcggtgccttgggccgtatcgcaggtatcctcggtggtcctgtatctgtaggtgtacaagctgctgtaaccccaggagaactcggggatgcagagcgtactcgtgcagaggaaatggctcaggccagtcaagcggttgagaacatgggtccagaggttgcccaagaggctaataaatgggctcagggtgtaggccgacgtgcagcccagaacgccacaggaggccctacgggagccggtctgctatcctatggggtaacccctaaccaacctgctatcgagcctgagatcgctccagaggtggcctctgcggcaggtgaagcggttgccaacgaggaggagactaatcgtcaggtaatcgagcagggtgcagccgaaggtcttcgctctggtgctgtaagccgtcctgaaatggcccaggctgtagttgaggctgatgcccaacgggaaggtgtagagctaaaaccccaagagcttaagaatcgggttaacgaagagttgactcagatgaggactatggataatgatgacctgtctcgttatgtatcttatgctctcattggtactggtcttctggcttcggccctagacaagactggtaaggctggggatatgttcgctgcttcctatgagcgtcaactggatcgcaacctacaggctgggattaaccagcagaagatggctgccgcagctgctgatcgtcagatcaaggaaaaggatctggagcgtaaggtggctaaggatgctgctgatgtacgtctcggggaaggaaacctggaggtcaagaagggcacccttgaggaaacctctcgtaagaacactggtcttctggatcggtgggctgaggaggctgctcgggggagagccaaccttgccctaacccagcgtggacaggatctggctaatcaacgggcccagctacaggctgaaacaacccgtcgtggccaggatatgtctcaagagaatgcccagcttagttctgctgtacgtctgaagactgctaagatcagcgctcaggcacgtcaagcggcagctaaggcagcccgaggtgaagctgttactactaaggacgcccttggtatcctgagtgaagtcaatggttctcaggctctgggtggtaagaagctgagtaagactgcccaacaggctattgcccagactgtccgaaatgaacttcgggctaatccgggggctaaccctgtaggtattatccagcgggaggctgctaagttgcaacctacgggtaactggtttggtgctgatttggactatcctgccccaacccgataaaaggtacttgacaaagtatccaaaatgtagtataatagacctataggctcttaagattccttcttccttttgacttacttactaagaaggttagtatcttaggatacatcttaagagcctattttcctttccagcaaatagaaggtgacttatggctctttctccagaactgaaagccgctattgatgcggaactggctgaggtcaaaggcctcgacgtagccgctgagttggcttctttgaatgagccagacgttatcgaagaggcacctcaagaagtagcccctgctacccctgagcctgccccagacctgagtgccctagtaactccggctgaccctaattctattagctccgcgattggtcgtggggttgataccatgcagtctaacatcggtggtaccattgctacccttggtgagttgactggcagtgactacctgaaagactacggcacacagatggccgaggagaatgctcaggaagcgtcacagtacggaacccccgatgttcggtctttcgctgatatccaagatatcccatccattggttcgttcctaaagaataacatcgtagaggctctcccttcgatggcccctgtacttgctggtggtgccgcaggtgctaaggctggctctgtctttggggccccaggtcgtatgggtggagcgctcattggttccttcctgagctccatgggtatcaacgtaggtgccctgagtaaccagatgaaggaactagaccccgatcaaagcaacccatggaccgcagtcctcggtggtgctggcctctcggtactagacactgcgggtgctggtgttatcgctgccccactcctcaagcacatcggtaaagatggagcttaccagatgttggtccaatcgggactacctaagcaaaccgctatcgaggctgttacccaggctggtaagcatgcagcagtctctggtgtagccgagggtgtaacctctggtgctcaacaggcgctccaggataccatcgcctatgatgcagtagggcaggtacaaaccccagagcagttcatggataacctcctgacggctgcctttactggtacagctatgggtactgctggtggtgctgtatcctctggtttggacaccctgggtcgtcatcaggattcagctggctctgccattgttgatcctaatgctcctgcggcccctcctaaggcgtctgagctagagcctaggggtacggttaagaaagcctgggatgcccttggaaacgaagctacgtcgctcctagagccactcgctaaggcctcccctatcgctcgtgagttctctgagaccttccgggctgatatgagtggtaagagggcctctggtaagactatctttgaggaccaggaactccaggcaggtaagtggaactctgaactcgataatatcttcgagggtaagtcttcgaaagaaatcgacaggattatctcagatacatccgcaggtgtcaataccccagaagctacccgtctccgtgctttgatggatgacgtaaggaatgaggctgttaaccgtggtggaatgtccgttggtactattcccaactatatgccattcggactatccccagagaaggttcagactcccgagttcctgaacgaaatcaccccgtatttccagaaccgacaggctgccgaggatgctgtagccaactggctggcagaagtctcggatgatactcgtggtaacactgcccctgaggttaaccgattggttactcagaaccagcagaccggggcttgggaagtagaccctcgttatcgtatccagggtgatccagatactctacgtggacggtttgcccaaagcgatgcagttcctaagtatggtcaactggaagagagccgggcctttggctccgtacctcaggagatcctcaataagtattctcttaatgatactcctaagaagcgtctccaggaaatccgagactacttcgaaggggcttcccaccggattgcctttaccgaacggtttggtatcaacggagagaaggctaacgctaagattgcatctgctgtagctgaggctcaacgggctggtaagcgggttaccaaggaagaagtggatcggatgtatgacctggtggatgcctataatggtatgcacggtcgtatcaaagatcctaaccttaagaagctggcggctgttacctctggtgcccttgtcctctcccgactgccacttgctggtttctctaccctgaccgagttcagcctaccattcgctaaggcgggggttatgcccacccttggtgctgtacttccaaccatgggtgaggtagtaaggcaagcagcccgcaggatctacagtggggttccaaagtctgagaccggtcggtttatgagtgatatgaaccacacccttgcttctgctacttctctgatggctgatcgggttggtgctgaggtgtttaactctaccatccaaaaggcgatccgtggtcagttcctcatcaacggcttgtccatcctaacccatgttaaccgaatatttgcaacagagactgccaagcgggtctatcagaataacctgatggatctagccgcaggtctccctttcagttctgccaatggtgctctgaaggttgctcagcttcgggaaatgggggttaacatcagtagtcagcaggatgctcttaagctggtatccccagctaccccatctgaagtcctgatggctaacaacgtcaagactttggctatgcgtcggtttgtggatcaggtagtccttgaccccaccttcgctgataagcctatgtggatgagcaacggaaacgttcagatgttctccctcttgaagggctacccagcagcctatggtaacatcatcctaccgatgttccgtaggcgaatgagcccccacttcgctggttcttggactaacgctggtatgggtgccgcaggtgtagccttcactcttggtctgatgatgagtcttgggtatctccaggatgagcttcgtcaactggctaagttcggtgggtctagccgagaggatacccgtagtccagaacaacggatgatggacgtagtgatgcaacagatgccactccaggcttctatgatctacgacatgctgacgggttaccgtcgagggactacccccgcagaggtactattgggtccagtagctggtgctgcaactgagggtgctatggctgttggtaaaactatcgcttcgtttggggatgacccatccgcaggtgaaatctggaagttcttgtataagcaaactccagcacgtcctttcgttgccggtatggaagcgatggaagatgctctggatctttaaggagaagtaatatggcaacttatgtagaaactgatgccgctggtcctggtggccgtgcctacgtggttgatgtgccaaaagtcttccgacgtaatgccgatggtgatctcattgagattacctcggatgccggtcgggtgaatactaacatcgttaccgctacagagttcctccctgactattatgcagttaaggagaacgcagccctggtagtagagaacgttacagcctccttcccggagaacccctcagaggccgttatcccctctgtcctggtcaacaccctcgtgggtgctcctggggaaacctcgggtggcaaccgtgaccctggccacgtgattggtctgttctctgagaccatgattgaggcaccttgcggtactgcattcggtagtgaattccgggtagaccctcgccgggaacacctgggtgtttacgtggctatcaagcacgtgattggtccagatgaccaaaacggtggtaccatcggtgactacattatcgagcagtttgacgacatgcgtggtcctgtgaagaacattggctctctacaacagaactaccttgacccacgccttgtgactactcacttgggtggtaacgtcgtcaatacccagcagcttactcagaatattaccctgactaagcaacagtctggatggttcttcatgtctcagggggctacagatattaccgtcaccctgggtccggatgtaaccccaggttgtcacttccattttatccagggctcggcagctaagatcaagtttgctgtatctccggacaaggcttggtacgctaagggtaaccagacggaaactgatggtcaattcggggaatgcactgtccgtgtatatcctttcggtggtaccgtgggtacctttaaatcggcagcttaattaggagttagattatggcaggttatatcgctgacaacgacggcaacagcgtattcgttattcaatcgaaggctattgctgtacgaaatgaagatgggaccctccgacacgtcattggcccgaaagattttgagcctgtgaagtgggaggatattgaggggaagccggagcttctggaggtgggtgctaaggctagcgaggctaagccaggtaactggaagcctaaggctagtgaagtggttggtctttatgaagccattgcagcttccgtaaatgacaaggtagctgagatccccgtggcttcctatacggatactcacgaggcactcgtggataagttcaatacactactgaacgctctccggagctaaagataaggccccttgggatgatacccttggggcctttttttggttactcgacggggtggtagactggtgaatccctataccgtaggttatcccggatgaactcctcagcatcttccaaggagtagaaggccataaagcaacctcccgagtccgtaacagttctccacataaagaaagacttcttttgtatgtagaagaggcgtttacctagctgctgcactcgatacttcataaggaacctgcccaagataacacttcgatgaggagtctggatatttctcccagggccaggagtaacatcagtcagctataccctacatacaccagtagggcaaacaaagctgctaccgcaatgtaggtccaagggaatccacccttacccttttgatctttctgcataacccctccaatctccgtagaatacagaagccctgaggtctactaggtctagcatcccttcgaggaattcaatctgtcttttagcttcttcagccagttcttcaaaggaaaaggccttcgcctcagccttcgcaagagcgctttgcgtctcttcaagtgctttctccagttcagcctttgtcatagtacaccaccttgtcactgctcctgagaacatattcagaatcaatagtccaactcatggtcgggcatttgatccgaagcatcttgggggtaaacccgtcgactacaccaatagctagatgggaggaggtgttcctgtggaccaggaagactacactgtcccctacctctagcttacgtcccactcgatctttcatagattaccccaagatatccggaaggtgaacactggggatgtacagggtttccaggacttcgatggaatacatcccacgcttaagcccctcctctgcaccccctttcccaaacttcatatccagccagagttctgcggagatcggcgtcttaaacgccaacccccgttgaccgaagtcatgctcagacttaatgtagtacaggtctggcaagaacttactcacaggaattcctccacactcatcagcttgaggtcatactctccgtccctgtggttccggagaagggctacacctcgccagtgatcgttaccctggggccccttgtaggactcatcatgggtgtagaagctaccgactacgagaccgtggattcgcttcttgcctactgcctcgatgtggtacttgaatccctgttcgtggccttggacgaagctgcgcttgatcttattgaggcgatgctcggcactcccgccgtatggccgaccactgttgggattgtagaagtagtgggcgaaggcgacaccttcgataacacccacgtcgaggaaatcatggacaatccaatcggacagatcaaaatgatcgtacccaataaaaccttggagagcagggttagaattttcataccgcttgatacgctcctcgtggtttccgatgaagaagtgcatttctggtcggtagatacgcttcttacaacccgcttggtgttgctgtaggcggcgaagaggatcgagcagaactcgcatcgcatcattaccagcttgtatgtcagcgaggactcggcggccttcgatcttagcggtaccacggtcgtagcttgacagactgggcatgtcccaatggtccccaatatgaacaattcgcttggggcggttacgtgcgatccactccccaaggttcccgaggtgatcgatgttgacctcggatcgaacttgggtgtccgcgataacgagagtgtcttcattatacttcttactcattagggaaggactccttgaaagtctctagagtaaaccagcggaagccattacgttcagcccattccgccatggattgctttgtgccatctttacgcttactaagccaatggcaagctgtgttaggacgctcgaagataaacacaagttcagtatctggggggagagcctccctcacccagatgtacttagatgcctctgaagcttcctggaagtaccccttgacctcgaccaacaggttcttcgtcgatccacagggttgtaatgtcgataccttgaagtccggcttgtacttgtgcttgatgacgtatggcaccggctccggcttgaactgcatccaaggcatcgtctcgtggacgatcttctcggtttcgctgtcgtacttcgtcccaatcaatgacttcagtttgggtctgaagaatctcccctgctttgccaatgagccctccttcttgaagcttacggacaaccgacagtgtactctcagtgaggatagagttagaccgaatcagaagccagatccaatcccctaggcacacccggaactccggatacttcagtttgatacgttggatatgggagacaaccttttcaacttggttgtcagttaggggctgagagtgatccagaagagggtctaggactcggttaagagtaatacacttctcttccttatcaaactcataagactttgtgcggtagatttgagacctcaagcccagccgatttacaggccagcatgcgatctcacacagtcctacatcaaactctgctggatgtgaatgagtggtcacgactaggttgacgggcaggtcaacaccaatagattcccacacatcaaaccccgcaggatacccatcaggcttatctccagtcctacaccggaccttcttgtggcccagcttgttgtagaaccgagtgacctctacttctagggtatcatcatcacaggggatcaaccgtgggccgaaccggctacggcgagtatcagtagggtcctccacgtatggcctacggacatagaggtcgatatccttgggtgcaaccccgttgtctgcatcccgaaggaaaccaccagcgaccttgtagtcagtgaagccaagaccttcgaggatctcaaagagaccttcacagatcctctgtgcttcatcaatagaatatttcttcatcgtcatagggaatctcccaatgtttcttcagtgagcagtgatactcgttaccggactgctgaatatcaagccaagagcggtcgcgaatgaggtagaggagacgaaagttttccacaaggtactccttccaattatctccgtacttctgttggtaggcgtaagcgcaagctgcgaagagatccctctcagtagaaagctccccaagcaaatctgccgctgtctttggtcccgtccctgggaggcctggtatgttatccacggagtcaccaacaaggagttgcccgtagaggaatgccgtaccgttgccctcaagcttccatgacttctgcggtttcttaacaccatacattcgccaagaagcggagactgttccaaggccatcgacttgaaatggtcccaactccggctgggaatccccacagggccaactgtaatggtagcatcctgggacttggcggatatccttgtctctagaacacgctgtaaagttatctccctcttcagtccctcgaattccgagccagtcatcagcctcgataccgtggaaagtgattgctccccacttgtccttaagtctggccgacacggtttcccagtgatgaggcttttcaagaccgattcgagtacccttatattgcttgattttcgcaagctccagcctaaaatttccttggccagtaaggtagatttcacactcatctgcatttacccttttgataatttgttcgactttatcatcgacgagcttatggacttcttcctcaggccatggcttctccacctggatatcgaagatgtgttccttcgacatagccacatgtcccaattcgtagcgaagctaaagtacgtcgccatcaattcctgcgatcatactacttaccctccttacgctggactactcccagcattgagcccacgccctgccatatctgatgttctgaacagtattgtatgggaagcctagtttagaaatctctgtattacctaggccatttttgattaaccggatgatctctttggcaactccctcatctatcttggaggccgggttcttgctaccgctgaagtctgcgtttcttcccttcctagatctatccgtgttattatcacccttagtcccaaggaataggtggtctggtcttacgcaggctgggttatcacactcgtggagtacatatagaccctctggaatctccccatagtgtaactcccaagagaaccttggggcgtacccaacactaccattccacttgaaacgacccctaccggccctatcagcagatgccgtccagttccagcaaccctcggtcttatcaaccttggaccagaacctctcagctatcatcacgatacctcttctacgacctgggattctttgagcttctcttcccagaagacacggagggcaaaggcttcacccttggctcggtactctgggtgctctaccactggattggccagtgcttcataccccttccagtcgtaatactcgctctcttgacgcttggctttgtccatagcttcctccgttaggctgtagcctgggggaagccccaggtctacatcgacgccaatcacagagtagttgctaggaacagtcttagcccttgggtccaacagaagttccattggattcctcctcttgctgaatgacgagttccagggacgctagggcgttccacacttcgtggtatcggtggggtagcttactttgggggtccaaagcctcacccttgtgtcgctcaaggaggtgtctaccgaaggcagcatcatatcgctggactccgttctcgacagacctccaacccccgcgactatacttgctggctccgaagttagcaacttgtgccactgcatatagagccctcgggaacgcttcgaagatgattccaacatccaccttgccgctatcgagcttagcgcccggctcaccaggtttgattccattaggatcgacctctactttattattagatgcagctgtagaactcaccacccgtacaccccacactctctcgaattcaattaagcagtaggggcagcctgaccggcatacccccgcctcgtgatcctccaagcccttagataggagcgtcttcgtcatcgaatacctcgtcgaatacgtcctcgggctcttcctcggtgaaggcaccaccgaacagcggatcgtcctcaccgtcaccaccggatacaatctcgtggagtcgtacaccgcgcagtcgtagggccgtcatagtacccttgcctcgtgggcccttttgggtctcgatcaggatgccaacttcaccagtagagccaccccacgggttggggccatcatacggcttgttgtccgaggtcagaaccaccggcttcattacagcagacttgcgctcaccgtcttgcatccaatccacgtgcttcttctgcttgaccttgaacaggtactcgccatcacgctcttggtatttgatggtatccttcagacgggcatctttggattccatctgttggaccagcttgtctgcctcttccttggtcggaatgcagatggttacttggtagacttcaccgtactcggtgtccggagttacgatgtaggggaagatcagcttcgctaccgggaaggtgaatcgttgggatactttcttagacatatcttaaacctctcgtagggaagaaggtattataccacagagggggctgaaagtcaacccacagatgtatcagtgtgtgtcataccatgagcgaccagcgatagaatcactagccaaaggacagttaaccccgaggagttccccagcatcccgaacgcagacttccatctgctcacgtagcgccttgagatcctctgggtggcattcccactgaccctcgtcatggatatccaagactttccaagccctcaggtttaacctgcggactcgctcatccaggagtaccatggcccacttcatgacaattgcacctgctgcttgtaggagggtgttcaatgccttgtggatcatcacgtcgccagactcagaacgtcgcatggttagcttccgtccgtctagcccttcgagataacctctttcggcttcctgcttaaccctctcaatcagtgcagcaaggtcagggttagcctcaaggaactgggcccggagcctagccccgtccgcccttgtgccaccaatgatagtcccaatcttggcatccccagcaccgtagatgaaggcgtagatgaacgtcttagcatcgtcccgtgtgggaagccctgcggctatctggttggccgtgtgtacatcaccctcgaccacctctttggtgtactctgggttgttgatgtaggatgcaagcatccgaagctctagaccagcaccatcgtagcccacgaataccaattgattcgctgggacgtatacccggtactttcctacagtcttccacttacccttcttgagttcctccacgatgttagtgaagggcctaaccctttcgttctctccaatgtctcggcggaggacagtccatttccattcaccggcatcaggtgtcccctggaacaaccctcggatttctggtccaaagggagaacgagcagcggggatattaactactacacggtgcctcatacggcccgtaggtgttgcacaggggttagcactcccctctaggcgtccatcaggcctcacctgatctaccagcccctgcaagagggaccgacggtgggcccaaaccattcgctgcatcaccagcttgcccaggtccccctggacggtatccatcgactcttcagtcatcttcggagtcgttaggaccttacgttgcttttcgagctttctcttgacttccccaatggtagttttcccagggatgattccctggagcttcattcggagtcgtccagatttgctctgtcggagatcctcaatgtacttattcaaggattcattaaggtcagatccacgtagcttcttgccatcagtgccgacagtaatatccttgatgttccattggtcaggtatccatccctgatccagcatccagtccttgaacttggcagtcttaccaaggtcgaagggtacatactcgattgcagagaagggaccagatacctcgaagtgcccaagacgttgccacagggactggagcctttggttcggcttaccactctttaggaatggcttgctgaaggccccagcccttacgatcatcatgggcatctgggggacagcctcaaggtcaatcttgaggattcgttcgctaagcacatggatcagccatttggcccgctgagtctggaagtagactccacgtttactctggcggctgatgatatcagctaccttgtgctcaacgaacagtgactttctccaatccacttaatcccccttaagacgctccgccagattctctacaactgtctccacagcttcgtgggatacaccctccaggtaggagaggtagtccacggtaccactgcggtccagcttccattgctgctccaggaaggccacagcaacttgcttgagcaggaagtcatctacccgctccatgaggatactcttgatcttgctcatgtaatcaccagtcgaaaatgaagtaggaacacccacgctcacaggccaggtctaccaggtaccaggacaggtcaatcttgcgctggatatccttaacgtcgctcagttcttcatcggatagctctaacccatcaccccgcttctccttcaggtattgaaactcccatttcttctcttcttgggaggtaaacaagaggtctcgcggatctagctgggtattcctgtcgatgtagaagtcgtcgtacaggttcagatccttctcccgtacccggctattgcgtttaggcgagtaggaactcagatccaggtgggagcctgagaagtagctcacccccaggaatccagcggggaggctcaggaatacccgacgcttctcccggagagtaatctggggactgctgaggaacttccggatgttagtcctttgtatctccatgctcttatggagggcagaggccatattacacaggtacttaccacggacatgtttggaatagcttacatggtcactcatttgtatctcctataggggtaaagcaaccccggacaccttaaggttattataccacacttttctggatttgtcaagccttcttgtggaacactttgtcgtaccacctgtagaagtattgagcagaggtaatcccaagggcacctccccacccggacacgaagataaaccatccgatatccaagtgggaagaggccacggccttgatgtaagcaaactgagccagcgtgatacaccaagatactacaaacccagccttgatcttatcatcccgaaggagcttagagttcagacccaggaggaacacctggaagaatgcactccaaaagatgactaggacttgtagggttattgacatgactcacacacctcggggtctaggccgcaggcactacccaaggggaagtcatcagcgtcgatctcggggccaccccagctaccagagaattccttctccagggcgatctccttgagtgcctgatcttccaggctttctttcttactggccatcgtcaatctcctctacagaaacccatccacggacagcaccgatctcattggctcggacggtcatggggttggcatcggaatcaccagcgaagaaccggatgatatccaactcgatgcggtagaagtctgcgttgaacaccttggtgtcctggaatccaacgttaactcgatacttcttcactcttacctcccagtagttcttccaggttagccagtaccttctgggccttcaggttgtcctgcatgacctgggtacgctccgccttcaggagactgatctcgttgtagatccgttcagattcctccgaagactcttggataaaggtcttcaggttaaccagcaccttgtcgaaggaactgaggatgttgctgatgctaagctttcgattgaacatagtgagtcctcgggggcccgaaggcccctcttcatttactttttcttgcgaatgcctttggccttacgatcgcccacccgaccaccatcagcagcgttagaagaacggccacggacgcgaaggttagaatccccgttaccgccaccatctttaacacgtttgatatgatcgacaacctcgtcggttccgagcttcctgccaagacgcttttccacctttcggcgggctcggtgccgctgagcatctcctgacttagagcccacgcccgtttcgccgcgtcgaatagccagttctctctcacgcttgtagttcctcactcgctttttagccaatctacagtcctccattcaacaagctcttgccaagtcatgccgagtacccggaggaggtagttgaacagtgcgtgactgaccactccatcctgaaggcaatactcaaacatttcctctgagaacttggagaagtcgttgaagtcacccttgtgacacttcaggaacttaccccaggctcccagggaatgaccctggggcctatctggccaagtcaacctcgatgcaaccaaggtgtcatagcttcggtcggggggtatgataatcccatgaagtttctcaaggacccggttgtcgtagtcaaggatgttgtgaccgactacgaactttgcatgggcgatgatcctgtagaacacatccatttcctcgggccggaatccccggactaccccagtcggaatgtctacaacaacagcgcaccaaagccttgtgaccgtattgaagaggccgtccccctctaggtcatagataacgtaatcaaattggggtgtcatcgtcagcaggtacctcgtcgtaactgccctcacgttcaaccaagcgacccgtctctgggttatacttggtaaacactaggccagtattaccgtagttcctgtccttgattacacggattctgctctcgtgcttctcttccccgtcagcctgcttgttccgctcgaatccgatcataagctgacaccaacgctgcatagctcgggagccggtgaactggctttcctttacctcagcgccttcctcgtgggtacgattacccttgggcgggttaaggtgggagaagatgaagatccgaagacccagctcatcggccatacctgcaagctctgtacagatacgggcgatctccgtgttcatttcggaaggactaaggtggttggtcatggcggtcatgttatccaggaggatagtcttcacatccatggctacagcccagaagcgaatacattccttgatatgatcccaatcgttctgacccttattcttccacatgaagagcttgccccggagtttacccgcagcgtctttaaaggcttgctcatcccactcgatatccggtctgtggaagggcacgttagctaccttccccgcgatattcttcagtgtcatggctacctgctcttccaacaggaatgtccctacgttctccccgtgctcaatgcaattccaggcagcaatctcgtgggccaacagggtcttaccgatgccagtacccccacctaccccgatgatctcaccatcacgctgaccgtaggtaaggttggttagaccttcccagggatagctcttaccccacttagggggttctagcgcctcagcgtatacctcatcgacagttacggaacagtccggggacttaaccttgctaccgaatcggatcatctggtagacctcatccccccgattacgcataagcatgtcgttagcatccttcagggggagctctacaaacttacactcggggtacagggcacgtaccttttctactgacttacgcccctcgtcatcagcatcatggcaatagatgacctcgttgaaccgttcaagtacaccagattcctttaggaatgcgatatctcgtccagcggaaccaacaccagaggaccagctaatggctgcctgacgcagatgcttccacttctcgggaagcttcgactccatgatctgagccacggacattgccgacagttcatcctcgcagatgactaaccgaaggtggcccatatccttatgccgaagggtgttataaccgaaggggtcaacaccacccttggggctaccccgatagtagaaagccttggggtctaggattcggacgttaaacgctcggtactccccatcgcgggtacgtggatagtaatgctctataacgtcctcaccattctcttgtgatagaccaacacgtaccccgtatcgttcagcgattgatttgctgatcttccgagtatctagggctttagttggatactcaaggacttcgttgacttcatggatgatatcctcctcggatttctcccttcgttcaggaaccttgaacccttcttcgagaacttcatagtggccgcaacggttacaactaccgaagcgggtacctttctccttgtctacgaacaagatgaggtgattacctgttttatccccacctttagctcggcaacccggacaagccgtatcaccgataatctgcttcacttattcctccatctggctcttgagtaccaagctcggtacagcattgacgttacccggcagggtcttgtaaggagttgttacgaaagtaccgtagaccttctccagttcacggagtcgatcctcgatcttcttcagtcgctcccacatgaagcgaataccaacagattcgtcacagtacccaccatagctggtctcgggactgtccgaggcctccggaatcttggagacctcgatagagtcttggaggtgtcgctgggaagctacaaggcccaggatctccttgaggagcatcttctgggcatgtagctcttggtgtccgaaggtgttcggagtatcgcggtagacttctactgctttgtctacggtcatttcattcattatactgctccttgtcgttttgccaggtgtgccttccagtcgccatcttggacgatatccatcgccatatggctatcctgatggtacaccagggccttaattcgttccccgttgattcggaagtccttgagggtacgatcataccaacccggataaccctccagggcatccaagttctccagcatttcctcacccttctcaccttcagggagttgccagatttcccctacgatgagatcagcgcgggaggcaaaggagaggatggggaagccgccagcggagtacatcagaccccgctcgcaggatacagcattgccgacaaactcggccccttccagaaggtagtggttgtacaaaccagacaggagagtaccataaacgaaaacacgaacagccattagatagcctcctcgaagattttgttgaagcccttgacgtaggcctccagggcgcttccttctgcatccaggcccggcgcggtgttgatttccaggacaaacgcccggctagtagcgtgctggtagatgatatccacagcgccgaagtccaggcctgcaacttggatagcttctgccgccgccgacatagcctgctcagcaccatcccgatccattgcatcgttgacgccatagacccagccgcccgctacgttacgaacgatgctttgtccttcgttggtcaccatttcattggcaacacggcggagcttgacttggagaagtactacttccccacggatcacatgggctcgaaactcggtacgcttaccgacgattccctgggtgaacagttgtgccctggtgataacatccgggatgtgggtgtgaccgtagatgtgtaccgggtagtggccctgtctacggagggcatcgattgcagcaacttctgcatcattgacagtacacaccagatggataccacgaccgctatggccgttcagatcggtacgtgcatacatgcgaccagagatattgagtacacccaaggcatcttcccagcgctcggtccaacggggaatcaagtgaggggcattggcctcgaagtggcggaagaactccagcttgttagcgcagcgataaacaactgccgggtcgttgaggaacacaggggcaatatcccggagtcggtgagcctctgcaccaacggtaccccagttgattaccgcagtacccgcacgaccccgataggtagacccctcggagcgaaggattcgagcacccagggcgttacgaagagcgacagcaccagcagaggggcgggcacctttatagatatagaacatggcaaatctcctgtttctgttgagggtagtgaagccagcaatagcccctggaatcctaagttagatcccatgtacgcatcttaggaactggcatgggtcggccaggggctattactaacgcactaccttactcgaagtagtcttcgaagagtcggtcgatagcttccgcaatgactaccggggccggtaccaggaattcctcgtccgggttggcatcattgagttcctgctccttgactcgacgaatcgactggatcttgtccagggtgtcacgggagaagggatacttacgggttgcgtcggtctccatctggatcactacttgacgcttgagagttacttgggtcattttgacctcctatttattttcgattacacactcaccacagatgaactcgcactcatccaggctaccagtgaacttggcaccttcgtataccgtcagatgacgattacgctggtcatatgcggttgggatcttcccgcaagatgcacatccctgggacacgaagtcccgaaagacatgcacgttgttgaaggtgtggccttgcaccttcaaggggtagctgatgttggccggaggggtattccccaaggtgccgccgacttgaaccctgggtttagaatgggatttcgtctccgatgagatcgttccaatcctcaaaaccggggtagtctccccaggagtcggccgatgctttgggtccaggcaacttaccgccagatcctcgacagtaaccttgagatcacggtcttggccgatgaagtaggcgttggagatacttcctcgtaggacggtgtagccgtggactttggcgacattgatgccatgagcttcgatgagaaggttttcttcacgctcgattccagtgacagttccgtactcgctgccgtttgcgtaggcctcgaccttgacaacatcgaaggtgacgagctgccggtgcttgaaggtgctacctgctgcatcaagattgttgttgatccggagggtgttccttgcgtacgcatcgccagacgttccatacgacgagcccgcttggctgcctttcgttcccgcttggctgccttggcttcggctgtagtcatcgtagtccgagacaccgacgtaacgactccaccatgccgctgcttgcctttcgctttcgggaatcgggaggtccagaaacgtgaccggagtggtctggggttctgcaccctttcgcactccggcctccgtgaacgggatagttaccaggacttcggccttcagttcagcgataggagaacgcaggcggatcttagcattgggtcgctccaggaaaaccttgagcatcccaggctccgatgcccatacgatggtcccggtggtggtaaccgccatgaacagaggacgatcctcgttacggatgaagttcaggctacgttccttggaatcccaccagacaaccgcagcagcaccagagaacttctcctcgaacgtcttcttggcaccgtggttggcaatggtagcgcacagcatgttggaatccacgttgtacttatcattgccgtccagcaggtgcaggccccaggtatctacggttccgttatgtaccatggtgatgtggtctacctggaaggggtgggcattaccatggtccgtcttgtcgcccatcgtggcgtaacggttgtgacccatgtagatgcgagcccgacccttgtccaggaactccttggtttcaggatcagccaggaagtcgtaggcatctactgcccgcttgtgaattcctacctcgttcttaaccgggtcgatcttggccaaaccggtggcgtgagcaccacggataatatccacggccaggagggatttgagaagagcgatttcgttatcactcgcgttagttgtggcacagaagcctaccaatccacacattgtatttctccttagtacatatctggttcgattgttacgccggtatggcgctgaaggtgctgcgggttatccatgagcagtacgaaggcatctcgaagagcctcttggtcctccagaaggtctcgtacacgcacttggtgaccaatacgacgcagagaagttaccgcagtaatcgccgtatccagtctaacctgggtacctgggaccattgccaagttgtaccgctctgctgcaccatcgagtagtctggaggtagtagatcgagccagcagcagcctacgatccaaaaccctctgacgctcacgttcctgctcccggagacgtcgctgacggttctgttcatcctccagaggatctaccccggagcgaacaaagcccatggttgccaccgcgagagtagcactggcgatccccatttcacgaccacccggagacatttcatagtccggagatacccccaggaagaacacatcacggagattcacctcggagagcaccttgaggaactcttccaggggggtttctgcgtgagccatggcgaaggccttgagacacaacatacgctgcatcaggcctaccatttcctggcgagtagtcagggcgtgagcaccacggaactcgatggatccgaagttgtgggttacctggaggttcaaggccgaatactttggccaggaggtaagacccaagactttctctcggtcaccttccggggccaggatacggcgaccgaaggtctgggccagccagtcgttgctgaagaacgggatgcagaagttactatcccgacgatacggctggcagtgatcgaagaaaacatcctcgaatgccatgtaagtcaggaccgttcgttcgtacaccggccactctacgtcccgcatatccatgtgcaggtgggtggagcaacggaaggtaggagccggaggggtttcttccatcgcacttacaaaggattcaacccgagtgattgccctctggccagaggcgggaccggagaagacatactccataccctcccgcagagagccgtcacccttcagatcccacccatccacttctggccagttgttgaggccttccagttcgacttcgaacccgaaggaagcaaccgcaggaagttcctcgtggtgttccggggcgatgatctggttcttacggaaccctatctgtgtgccaataactgacatagcaagtcctcctggttcttgaattgttcatctgcggacagccgcccatccaccatctggccaaccttcactcccttccagtgtacaaccccatccttgatgaagaagtcccggtgggagggagcagagatcatttcctcggcctgggtgaagattcggatcatcatttcgccggtgatagcctgttggccatgattcagtaagatgttccggggatctacacccttgcgctgggtacggttgttcacgaggaaggatacataggtatcacgaaccccacgaccaaagacgtcatagtacccactggagggccgcacgctttctacctcgctgtagacaacccctccgtagtagttactgccgtcggggcgatacacgttgccaaggagacgaaacccgtcgaattgacggtcgtcaccaatggactcggtatcgtccacgtacactacccgaggctcgccgtccacccggaagaaggcataggtggaggagtagtacatgttgaagtctccggacaaccgatggcgattattcaggtcattcatataccacccccagcgctttaagtgcagctaccgccgcggcgccgtcgttctcgttgatgattcgctggacttcatcgccagatacgatggacttgtactcctccaggaggtgcttggaggtgtaagcccgtactgccatttcatagacccactcggtcaggtctacagagaagatccagaagttcgacaggctacggtactcgcctccgtagggcttatagcgcattgcgccagccttgccgtacagcttcttacgctgggtgtcaccgtcgaggatgacagaggccaggcccaggaggtagtcacacatctgcatgacttctcgggtgttcgccttggtgactcgctcgatgtggctgaagccgatatggacgtggccgccagcagtgcgcagggtcggaggggcatccttcggcatcacgttctgacgacgagtccagcagttgtagtccggctcgcaaccgaagacgtaagcctgggggccgaagctgcggaggagttcctcgtcgtacaggtgagaggacaggttctcgatgatgttcaggccgaaggggtggagcatctgagcgcccaggagtcgaacggaaatgatacgcttcacgaactcttccttggtgctggccgggtcgatgttgtactccagaagaacgttgtcttcctggacggcaccaccggctacagccaaaggggcttccttggttccaccgatgaagccgatgacgctctgggggttacggtcgtagccgacgaaaacttcaggatctgcaccgatcagggggattgcgttgttcattgcatagtctccagtttttcgaggatttcggggatgctgtagggactggtgggtacggtctcagacctttcccgacctgggtcacctacatcaatggtgattggggccatgatggacaggatgcggtcatcgtgtacaccttcgagcccgtcgcattcgatcaggtaatcgtccttggtatacccctgccacaactcagcgtcgtgatgcttgagcttgtccttgaactcttcgcgagtccgctcatggatgctcttaatatcgaagtaggtgatattcttgtatccacctacgataccatccatgacctcgtttatgtagctgtcatccacctcccagccgtggctctcgcagccctcccggtattcaccagcagtcaccgggaacatggccgggtagctgtcgcaatgagcagtgctacctacctgggcacaagccgcgagggtgaggatctctgcattgcagcccaggatcttatcacgattttcctgggtgatgcgacgcatggaatcacctacacaccacaagcgatcgcccattcggagggcacagatgatggccgatgcgttcttcctgaggtccacccgtacatacactgcctgccggcggcctgggggtgagaagtggtcgggatcgctgaggttcttgaggtcatcgttgtaatcccaccaacgggtaggccagtcgatggaagccgagagaataccaccgtcggtgatcctgttgaccaaatcactgttcaggaactccaccagtttaccagaggtattctcgtgggtagacaccaacaggtgtccaaccccggtaacccaccggtcgcccccaacgtcggaggtccggtcgcaataggccccgaagcagtttgtatattcggccatcctattgaccgagtattggtgtaccacagagccctcggcatcatagtacacattatgggctgcatacattcccatttgatttctccttggttgtcagaagtttttctcgatgaagtcttcgagggccagtaagatatcctttatgccgctcccccagccaacctcacccatggtccccaattggaccaccccgtgcttttcacagtcagaaggattaagccggaggaatcctcccagttccgtatccacggtgtcgtagggggttttcttgccgaagatagttggctgggggtaaatagttaccacctccaccttgttcagcttaatccccaggtattctgacctgtagggcttggaccttacccactcacgtccacctggggcatcacggttgggcatccaaagaccgaatcggttgcactcttcggcggactggatgtggatatcgcccttcttgatatcctcccaatcactactgaacatgtagttggtgaggggatacccggtgtagccgttggctatcaacccgtggaaggacattgcgaggtaggacttccagaagccatacttttcagcaagctccatgtgaatcttctcctctcgaccttgagggtctagaccactggataccagcttgaagaggaacttcatgatgggataccaggaatctagggtatgttccttggggttgaagtagataccgcagaccccttcttttccgtgatgggtgggggaaatcatttccgtcccgttagaatacttctcgaagggggaatccttggccttgctttcgtaagaccagaagtggaccttcgggattttgaaggccttgccgccgatggtgatggtcttgagttcaccttgggtacacttgttgagtacatcgatgaacttcttgcttcggcgggagcagatgaaggtccaaccgtcgagcttataaccgtgggttaccaccccctccatggctccgaagcaggaggcagaggtcattacctcgagggccttaaccccgcccttcttggatttcataccgaaggcgtacttgatacgggccatttgttttctccttggttgagttagccagcaatacccccaggacaggaatactaggggtattactagcgacctctaagttacttagaaggtgccacggcgctgttgcttgcctttggttggtgccgacaccttggtggccttgaggttgccgttcagggtcaattcaccgttggagcagagacgctcatagaaaaccttacgcttacccattgttcacctccttagcgaacgttgatgaagggcatggcttggccgccggtgacgtaggtaggcagcttgccgtcccacttctcaatggcattcagttctaccacgccggggttctggcggagggcttcaccctggatgcggaggctttcggccttaccttgagccaccaggatagccgcttgcttctcgccctcggctgccgcgatagccttggctgcctcggcttgggtctgacgaagttcgttctcgcgctgcatcgccgtctgagtggccttgatcttggcattgatcgcctcgaccacctgcgccggcaggccgatcataccattgaggtacaggctttcgacgatgatgccacgggtggagaagtgctcacggacggcagcttcgacttccttcacgaaggattccttgcccggaccatagatggcctcggcggacttcttgctgctggcgttgttgacggcgttacggaccacctgcggcacgttcacgcttacgatctcgttcatgcccttgcgataggtctggaacagcaggggtgcgctacccggagcagcccggagggtgacgccgatggggaagtccagcttcaggccgtccttgtcctgggcagtaaccaccgccagatcgaagttctggttgaaggtggggaacttgaacaactcctcgttgggggtcaggaacttccagccgaccggggtttccttcagatcaacgcccttggagtcgcccatcatgttgacgacgacaccggtatagccagcgggaaccttggagcaacctgcggtgatggcgagggtagcaatggccaggaggccgaggattttcttcatatggattccttacttgtagagaaggggagtgatgtagaccatgcacaatgcgatgaacatgatgaacatcagtacatagaagccccaatcatgcgggggcttacctgggtggcccagcaggccgtctatcttatgtatgttgtcgtagaggtcggaggtatctcccccgatgccctctaagtccttttggattgccttacggaggcggtctcgctgctgttccgtcatagtacatcacaccttcaccttgagggtttcaccctcgggtatcgccacgaaatacacggggagttcccgagggtgaatgtacaggacactcccattgcagatgtttaccatcgggatggtgaggtccttccgggattccgaacgaagatatatctgagaatcgcgcttacgttcgaagtaaagggggagggttgggcccttactgattctcgttaccgtggccacgatgcacctccttctttacagagagtttacctgcgtaggagtacaggtggctgacagcccagagggagtacaggatggagattaccaggagggcggcaccgatggcgttaaccatggtgttagcgggggaaagcatctggggtactacccagaggatgcttacccatgcggggatagccagaagcattacccgagtgtagagcttgaggaccattgttcttacctctttcttaagatgaagaagatagaaggttagaaccttaggtatcctaaaggatataaagcaaccccggacaccttaaggttattataccacactttcagcagaatgtcaaggcctagatgttacagacctttacagagcttgtcgaggtactccgagtgctcgacggtaccggggtagtcctgcaacccaccgaggtgacgacggagaaccccatggttgatgaggatctctgccgcagccttcacgttgatgacgtggacccggaccttggtcgagtggttgtcgctggatgcccaggggttgtagtggctgcccatacggcggaggatggtatctgctacaacctgctcgctgttcaccgtgaagaccatcgtaccgtggccctcgttggattcacgacggatggcgccgatcagttccttggcgaaacctcgggggctgaacccgttggatgcgaggccggcgtaatggtcagcggtacccgagggtcccatgccgatgtagatttttgcggtacagcaggagggaaagtctctgcggtgcattagtaatctcctttgattagtcgtttggccgcacggatggtggtagccaaaggtttccagataacaaccgagaagcacatccaaggtagtgacactggccacaggataccgaggatgattgaaatgtcctgatccttctggctcatccttccatgctcatcgcaatttgccgccaacccggcgatgccagccacgagcaaagataaagccatatagatcaggatcgctgggattatcaggaggtatgtcatcatttgctgcggaccaccttccgatgtacgtcaccgcagcgatcacacctcaggtcgtaatagtggcagagttccactagccgacccttgtgacgaatctcgtagggtccaccatcaagtatcttgtaccgatggacacccaagaggcaccaaagattaccgagatccatcaccaatccctcgcgcagttgcaacaacgaccctctttgggaccgaagactggcatacagtggggacaaggctcaccagattggatcatagcctccctggcgtgccgcaagtaagccgatcggctggactccatacctacggcagccaaggtgaaaccaagctcaccacggggctcctgggtgccttcctggaggctcatgttaaacccccgcttttctacacgacgcttcatgcggcgctcctgggccattatctggccgatcattggtttattcttcatacggcccccacatacaggaattcaccgacaaccatttggccgggaatagctcaaggtgagtaccgatttccttgcacttgaggatgttgaagccatccttgtggatgatggtaacgagttcgcccttcttgaggtaaaccaggtcgccagacccggaatcacccgaatggacgtaggcaccatccgccatctggctgatgtggaattcaacccttggctttgctacagacacgctgaaagaagtattggtcatggcgtcaccttactgaacccgatgaacgatgtggtccaccgggatgccgagttcgaagaaggtttcggtgatgaactgcccgaaattgatgacctttacgtggcgctcaccgtccttgcttaccaaccagaaaacctggggtttagtggagttcatagatgatacctacacgtttgccgaagatagatacacggatgtgggtcacgtaccaaccagggtacgccttggggttaggctggaacctgcggatgctgaccaaggattccaaccagaggaacaaatacagggcgggcgtcataacaaatacagggcgggcgtcatagtacacctacctcacgatgcaaaagggatgctgtccaaggtcgaggacaggacgaagagaaccacccacgctaccagcaacaacccattggaacgtgagcgtatggcggcacatgcaatatacttccatgccatcaccgcgccctgttcttagccaaagatgcacgcttggcacggagcttgttcaactccagggttttaccaaggtggctaccattggtattggtaagctcacgagttaccttggcgatcttgcggtcgatagcctcgatggcttgcatgttgcggctaaccttacgatagtcattgcgtttcacgggatggtttccttagttgatttcccaagacgccccagcctgcgaccataggtccggtgggggtttcggccaggaatcaccatggcctcatcagttgggtcagaggatacccatctcttccttccagtcgaggaagaagaagtatccgatgcctacgcaagacaccacgatagcgatagtcatttcttcaacctcttaatcaattcctgttgttcttgcttccacttgggatcggggtgaacccgcagcatactcgtgagcttctgcaaccgattaaccatgagtgccctttcgtgggctgcttcgtagggggacttcatttggtccacccgcagaggcccatgcaacggccttccacatagacgccgcaggcgaatttaccatcgacgaaagcccaacggtaaaccacctgttcaaccccgttgctattgtacgaacgggagttacaacacccttgcacgtaatcgtttgtaacagctaccagaaagctaccaaaaggggtccacacggtcctatcctcggttagttcatccatacaatacacggacctaccatgtactctagggaggaaccaaggggcgcgtcatagtacgcccctggccctggccgttatgctgccttcgcttcgtccttgacttccagtcgttggatgatggcgatacgctcgtcagctgcctggagctggcccttgtcgatggcgcgctggatcttggacttgaaggcggcgatggcttgatcgagggagaactcgtcggccacgtcacgctctttcttgtacttgaaccagggtttctctgcggcacgctccagtcgagtggccttgtccttggcgatgacgaacgggaattccttggacttttccttgtcggtattggcctcgatcttgccgttgtctacgaaccagtgggccagggccatccggcgggagccttgcggcatcgctttgaacagcttgcaggcaagagatacctctccgtgctcgtcgatatgcttgagaatgtccagaccagtagtctgaatcagattgtccagggacgcaccacgcttggcgatggtcttgatgatcccattgatacgcttgtagtcgctcatagattatacctcgggtttgatgtgggttacaggggagttcttgcacttgctaggcttgtaccaattgcgtagcttagtgtcctcacggttacgccaatcggtattcatcagagcctttcgcttgcgtgcaccagccttttcctgaagggaaacatacttgctgtccaggatcttgttacaattggaaatgatcccgaacttctgttctgcccgctgctgagctttgccaaggtgcccaatgttaataccttgagcacgagccttgcggctagccttgcggcgcagcttcttatcgatagcagcgttcatcgtttcatccttttggaatcatcagccgggacacacatcccgatacgataaaggggttagtcggcaaaccttggcattggcgtagccggcccctttccgcgttagtatcgctgttatggtctgtcctctggctatcctcgggagtcttcgtgtctactcgtccctaccttcgccagtatctaccaagcttcgccctctgcgctaagccattgatactaacccaacatactgtccatcacgattccaccatggactctgctaattgtttacgctggagcaggcaaccagtcggaaagtcataaggcggcgactttcaaagccagcgctctaaaggagtatgcgctattccctcagctttcgggtttctcccctgttcagtccaaggaccgtcgagggtacactttccctaggtggccgtcacctgatgggtgcccatgttagaggcttgggcttgccttgtcaaccctctgacgggggttagttcgtccagttctctggcataggctcttttgctgagcggccatcagtcttgcttgtcaaggctacgctaatcccgagggagtcatgcacgttatgccgttgacgtggggcgaactataccgcttcacctatcccttgtcaacccccgatgcctgccggccttacacttgggtgacttgggcgctcttccctggttggcagcccccggatagcactgcggcaagggggatggtggccgaggtagaacgtgggggccattagacccggttccgcggggtttgtcaagcccctggggtttcccccgttgcctatcggtttccctcaaggcggcgccattacgccatattctttacggggttgtctactggtttttcatacagtctaaggactatcagtcccccagcaaacccccggatatagacagtctttgattaacatagggtatcgtgggatgtcaatgggggatcaagggatattccccccgatccaccccctgaataccctaagatttttcttatgaataccctaaggtccacccgatgaacggtatctcaaggggttgacccacggactaatcccatggtatcctagggaggggctaggggctatacccctggggataggccacccccactttatctgggggactcctgggggg

The invention claimed is:

1. A method of treating a mammal comprising the administration to said mammal of a composition comprising at least two distinct bacteriophages having lytic activity to a *Pseudomonas aeruginosa* (*P. aeruginosa*) strain, said at least two distinct bacteriophages being selected from the bacteriophages having a genome comprising a nucleotide sequence of any one of SEQ ID NOs: 1 to 13 or a sequence having at least 90%97% identity thereto.

2. The method of claim 1, wherein the composition comprises at least three, distinct bacteriophages selected from the bacteriophages having a genome comprising a nucleotide sequence of any one of SEQ ID NOs: 1 to 13 or a sequence having at least 97% identity thereto.

3. The method of claim 1, wherein the composition comprises a combination of all of the bacteriophages BP1384, BP1429, BP1430, BP1433, BP1450, BP1644, BP1647, BP1648, BP1649, BP1650, BP1658, BP1661 and BP1662, said bacteriophages comprising the nucleotide sequence of SEQ ID NOs: 1 to 13, respectively.

4. The method of claim 1, wherein the composition further comprises a pharmaceutically acceptable excipient or carrier.

5. The method of claim 1, wherein the composition is a liquid, semi-liquid, solid or lyophilized formulation.

6. The method of claim 1, wherein the composition comprises between $10^{e4}$ and $10^{e12}$ PFU of each bacteriophage.

7. A method of modifying the microbial flora in a mammal comprising the administration to said mammal of a composition comprising at least two distinct bacteriophages having lytic activity to a *Pseudomonas aeruginosa* (*P. aeruginosa*) strain, said at least two distinct bacteriophages being selected from the bacteriophages having a genome comprising a nucleotide sequence of any one of SEQ ID NOs: 1 to 13 or a sequence having at least 97% identity thereto.

8. A method for preparing an antibacterial composition comprising at least two distinct bacteriophages having lytic activity to a *Pseudomonas aeruginosa* (*P. aeruginosa*) strain, said method comprising separately producing one or more of said at least two bacteriophages comprising a nucleotide sequence of any one of SEQ ID NOs: 1 to 13 or a sequence having at least 97% identity thereto and combining said one or more of said at least two bacteriophages with a suitable carrier or excipient.

9. A bacteriophage having lytic activity to a *Pseudomonas aeruginosa* (*P. aeruginosa*) strain and having a genome comprising a nucleotide sequence selected from any one of SEQ ID NOs: 1 to 13 or a sequence having at least 97% identity thereto.

10. The method of claim 1, wherein the composition comprises at least a bacteriophage having a genome comprising a nucleotide sequence of SEQ ID NO: 1 or a sequence having at least 97% identity thereto.

11. The method of claim 1, wherein the composition comprises at least a bacteriophage having a genome comprising a nucleotide sequence of SEQ ID NO: 2 or a sequence having at least 97% identity thereto.

12. The method of claim 1, wherein the composition comprises at least a bacteriophage having a genome comprising a nucleotide sequence of SEQ ID NO: 3 or a sequence having at least 97% identity thereto.

13. The method of claim 1, wherein the composition comprises at least a bacteriophage having a genome comprising a nucleotide sequence of SEQ ID NO: 4 or a sequence having at least 97% identity thereto.

14. The method of claim 1, wherein the composition comprises at least a bacteriophage having a genome comprising a nucleotide sequence of SEQ ID NO: 5 or a sequence having at least 97% identity thereto.

15. The method of claim 1, wherein the composition comprises at least a bacteriophage having a genome comprising a nucleotide sequence of SEQ ID NO: 6 or a sequence having at least 97% identity thereto.

16. The method of claim 1, wherein the composition comprises at least a bacteriophage having a genome comprising a nucleotide sequence of SEQ ID NO: 7 or a sequence having at least 97% identity thereto.

17. The method of claim 1, wherein the composition comprises at least a bacteriophage having a genome comprising a nucleotide sequence of SEQ ID NO: 8 or a sequence having at least 97% identity thereto.

18. The method of claim 1, wherein the composition comprises at least a bacteriophage having a genome comprising a nucleotide sequence of SEQ ID NO: 9 or a sequence having at least 97% identity thereto.

19. The method of claim 1, wherein the composition comprises at least a bacteriophage having a genome comprising a nucleotide sequence of SEQ ID NO: 10 or a sequence having at least 97% identity thereto.

20. The method of claim 1, wherein the composition comprises at least a bacteriophage having a genome comprising a nucleotide sequence of SEQ ID NO: 11 or a sequence having at least 97% identity thereto.

21. The method of claim 1, wherein the composition comprises at least a bacteriophage having a genome comprising a nucleotide sequence of SEQ ID NO: 12 or a sequence having at least 97% identity thereto.

22. The method of claim 1, wherein the composition comprises at least a bacteriophage having a genome comprising a nucleotide sequence of SEQ ID NO: 13 or a sequence having at least 97% identity thereto.

* * * * *

UNITED STATES PATENT AND TRADEMARK OFFICE
CERTIFICATE OF CORRECTION

PATENT NO. : 10,077,431 B2
APPLICATION NO. : 15/031763
DATED : September 18, 2018
INVENTOR(S) : Flavie Pouillot and Hélène Blois It is certified that error appears in the above-identified patent and that said Letters Patent is hereby corrected as shown below:

In the Specification

<u>Column 24,</u>
Lines 34-35, "*Proteus Staphylococcus*" should read --*Proteus mirabilis, Staphylococcus*--.

Signed and Sealed this
Sixteenth Day of July, 2019

Andrei Iancu
*Director of the United States Patent and Trademark Office*